United States Patent 8,278,038 (METHODS FOR THE IDENTIFICATION, ASSESSMENT, AND TREATMENT OF PATIENTS WITH CANCER THERAPY) - sequence listing, part 2

SEQ ID NO: 567 - DNA, 3669 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggcctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaggacacacggaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgcccaggggcagattgggtgtgacctctccactcctccatctcctgctgttgtcctagtggctatcacaggcctgggtgggtgggttgggggaagtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 568 - DNA, 4243 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaaaaaaaaaaaaaaaaaaaaaaaaaaaaaaaaaaaaaa

SEQ ID NO: 569 - DNA, 1387 bp, Homo sapiens
cacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattgg

SEQ ID NO: 570 - DNA, 1125 bp, Homo sapiens
cgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaaaaaaaaaaaaaa

SEQ ID NO: 571 - DNA, 1807 bp, Homo sapiens
ctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtgctttcagacttggtctatacactggctttctcttgtggcttctgtagaaaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctggatatttgaaaatagcagtgtgttctctgatggttacctgcagtggcaccctgtacaaaaaataaaagacttattggtgtaaa

SEQ ID NO: 572 - DNA, 2592 bp, Homo sapiens
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaag

SEQ ID NO: 573 - DNA, 679 bp, Homo sapiens
cgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttcagttgcacatcacgatgcctttctcgtcgcccatggaagcggagctggtccgcaggatcctgtcccgggatgccgcacctctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgaaaaaaaaaaaaaaaa

SEQ ID NO: 574 - DNA, 1375 bp, Homo sapiens
aaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaacaaaaa

SEQ ID NO: 575 - DNA, 1666 bp, Homo sapiens
gattctcgccctgagcaacggcctgacgtcggtggagggaagcaggcgcaggctccgtgaggaggcaaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggaggacctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaataaaaaaaaaaaaaaaa

SEQ ID NO: 576 - DNA, 752 bp, Homo sapiens
atcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaa

SEQ ID NO: 577 - DNA, 806 bp, Homo sapiens
agcagggggcgctgtgtgtaccgagaatacgagaatacctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaaaaaaaa

SEQ ID NO: 578 - DNA, 708 bp, Homo sapiens
ccaagaaacttccagtttttatttttaaaacatcattgtaacaagaaaaagacattcaaccaaattaaaaggaactaggtgggattaatttacaatacaaataatcaagcttaaaatatcggcccttccatttagggccaaggaggccaatagttcctgtttaaacagcagaatggcacgaattatttttacctgatattggatgggcacaaaaaaataagagtcttacagacttccacggactatcctcccctccctccagagcagagtgcatacaatgccatcttaggtcagtactcaggcttttaaaaatcatcttacgtttggagaatataatacaagctactcgggtaacaagaatacttttaaaacaattcttatagaaaacaaatacctggagataatggtgtggcagcattagacggctcaaagaagacagcaaagatgaaacaataatggtacaagaattatagtccctggtttatagaagaccatccaagataaaatattttccctaatttccgttgcttccttataatttacttagcagagatgaattacaagaagcagaacgcaccatttatgggtcctgggtggtagctgccaacttaggagttcaggactatcagatataaagcaatatgattatgctcacaagctctggaatggtaaaaaaccccaagatatctctaagggttctctatcttg

SEQ ID NO: 579 - DNA, 815 bp, Homo sapiens
gcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttcttttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttataaaaaaaaaaaaaaaaaaa

SEQ ID NO: 580 - DNA, 519 bp, Homo sapiens
  misc_feature 485: n = A,T,C or G
tttttttttttttttttcctgtacaaaagaactatacaatttacatatatatttatatacagcatataaatctctttcttctcagccccaacaacaccctcccccacccccccaaaaccctctaaaagttgtcagtagcagatccaaaaacttacaataagagagagaataaagtctttcttccctttccttttcccactgtggtattagatattggtgttttaaaatgaaaccaaaaacaaaacacgcaagtaagagttattaaaagtgcaaacatggtgggcaccacttatgttacacgggatgtggcagggccatgggcaacgctgaaggttaggtgtctggtgatccatcctgcctccctggactctccacctgcccttgggttttctgctccttagacgaggcgtccttctttgctaacacccaggcagcccttcagctcaggcagtgaaatgaccttgtctttgttcaggtcacagtantcggtgaaacgccgggcacatttcttgggcttgg

SEQ ID NO: 581 - DNA, 534 bp, Homo sapiens
gtagccatggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaaccatggttatcctggaaaaagaagaaaagagcttcttctttgcagatgaaaataaaggtgtttttggtcaaaaaaaaaaaaaaaaaaaaaaaaaaaa

SEQ ID NO: 582 - DNA, 622 bp, Homo sapiens
tttttttttgaaaagataggtttttattcatcaaaagttaacagcaacaggcacatattaaaatgagtatggcaaagccttttacaaatggctttacactcaagctttctcccaagaaaatggctgttgcaacaaactgtaaacaattaataaacagtcttttacagtaacaagggaaatacaaatgaactaaaagaaagcaccggtttctcttaaaactagattacagttgtgcttactatacataaaacaatttaaaacaaattacaaaagtggaatgtttgaagtttaaaattagtccttatagtttgtcctagaaaacatctgttcacatcaaaaggcccgtcaaagggtaacgtttcatcaaagggagggacaagaaaacaatgcacttttttcaaatcaaaacaagaagtttggtcacttagctatgtgcatagtttaaggcaactggagcaatctgttacagcttacctaccaaccttcccctcccccgagtgtggctgctcattatgtcacattctaaaataataaataaaagcttacatttcaaatctttgcccacatggagaaacataacatgcacagtcacacatgcacaaacatgcacgcaaacacacat

SEQ ID NO: 583 - DNA, 1783 bp, Homo sapiens
cctctcggagctggaaatgcagctattgagatcttcgaatgctgcggagctggaggcggaggcagctggggaggtccgagcgatgtgaccaggccgccatcgctcgtctcttcctctctcctgccgcctcctgtgtcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagcgccccgggccgcccccgcacgccgcccccatgcatcccttctacacccgggccgccaccatgataggcgagatcgccgccgccgtgtccttcatctccaagtttctccgcaccaaggggctgacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatccataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatttttaacc

SEQ ID NO: 584 - DNA, 1006 bp, Homo sapiens
gtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaa

SEQ ID NO: 585 - DNA, 1040 bp, Homo sapiens
  misc_feature 4, 5, 6: n = A,T,C or G
tagnnnttaatatatagatattttagatttgacaatcgtttccacatacactcagacaggcttacagaagaatttcaaatatcaaatagagaagctgttaattcacgcacgttatgacttcagttaattcttccagtgtttagmcttcagamcygctaataacactaaactcaataccgtgtttgtcgagtctgtcaatcaactttsttttssmaaammccgctccacgcgtgamgmccccgcccgccttakgcagatgagaggcatcacttagaagggtcatggctgcstgakccatagctatgggggtggcsacatagccagcctctggtcctttcacctgagtacaaattttgatatttggtttgttcttatctgtaccagtgccttggctgtatccttgaccaaagaatgtcagcgtgaatgaggcagcatcaatctgtttttgtgttgggccttgttttgaaaaatagccaaaggagaagaaccatgggaattttatgagaagttgccttccaattccaaacctcacaaagaacaaaaagaaaagtcctgcaaacatcagctkaataacagaggtgatgcctcccacagttacatacgcagcatactgaactggtgattcctctaaattttcatacaagtaacgttgagtcctccttacaacagacacatcagatcccataaaaggaatggaataacctttgagttcccgacaataagaaattggccaccttctcttcaattttggaccaatgagcgggacaggtttcagatttgatacatttcttagttttctcaaattactctgatctccaaaaccataaattgctgacttccaggtaccatcatgaatgctcaaacccctcaggtcctgaatgtatagtcaggaaactttccacagcagtcaaagtaccattcattttatttctggtatatattactcccagatctgctggaatggagtcaagccgctgcttccaatgatataaaccctttgtctgmgctttctcatgawaytcagttgmatagttccagaa

SEQ ID NO: 586 - DNA, 628 bp, Homo sapiens
cctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgt

SEQ ID NO: 587 - DNA, 1244 bp, Homo sapiens
gccagtcggtgcccctcccgctccagccatgctctccgccctcgcccggcctgtcagcgctgctctccgccgcagcttcagcacctcggcccagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggctacctcggacctgaacagctgcctgactgcctgaaaggttgtgatgtggtagttattccggctggagtccccagaaagccaggcatgacccgggacgacctgttcaacaccaatgccacgattgtggccaccctgaccgctgcctgtgcccagcactgcccggaagccatgatctgcgtcattgccaatccggttaattccaccatccccatcacagcagaagttttcaagaagcatggagtgtacaaccccaacaaaatcttcggcgtgacgaccctggacatcgtcagagccaacacctttgttgcagagctgaagggtttggatccagctcgagtcaacgtccctgtcattggtggccatgctgggaagaccatcatccccctgatctctcagtgcacccccaaggtggactttccccaggaccagctgacagcactcactgggcggatccaggaggccggcacggaggtggtcaaggctaaagccggagcaggctctgccaccctctccatggcgtatgccggcgcccgctttgtcttctcccttgtggatgcaatgaatggaaaggaaggtgttgtggaatgttccttcgttaagtcacaggaaacggaatgtacctacttctccacaccgctgctgcttgggaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttaaaaaaaaaaaaaaaaaaaa

SEQ ID NO: 588 - DNA, 539 bp, Homo sapiens
ctttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaaaaaaaaaaaaaaaaaa

SEQ ID NO: 589 - DNA, 4041 bp, Homo sapiens
gagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactaaaaaaaaaaaaaaaaaaa

SEQ ID NO: 590 - DNA, 768 bp, Homo sapiens
gctttttgaggaagacgcggtcgtaagggctgaggattttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcacccttaaaaaagccgaaagctgataaatctccttggaaagggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcacgattacttccatcagtattgagccaggagttgaggtggaagtcaccattgcagatgcttaagtcaaactatttttaataaacgttgatgaccaggtgctaaacactaaaaacacacacccaaccaacacaactgtggtgggcgcggcctggcgcctgaggaaaagttttctagacacccacgtttgggggcgcggccccactgggccgtcgcacctggtcatcccgtcccccgcgacccgggcaccaatcggccggggtttcccccaataaaacccgcgcgcccagcgttcggaccacccatggctcgggctccgggctcaggggtcagacttttgg

SEQ ID NO: 591 - DNA, 599 bp, Homo sapiens
tctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataag

SEQ ID NO: 592 - DNA, 2372 bp, Homo sapiens
aacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacattaaaaaaaaaaaaaaaaaaaaaaaaaaaaaaa

SEQ ID NO: 593 - DNA, 666 bp, Homo sapiens
ttttattaggcaaagttcattttatttaactcactactgtgttaacaatatagctataaaaagcttcaatacaaaacttgtgtaaaaacaactaatatctgacaaaaactgaagtacacaaaaggaagtaggctttctcataccgttaagacttcttatacatcttatatctaaattttttagcagactgtcatctcgtagatccaaatcttcaggaattgtctgcagtgctaatcttgcgaacaaaatattcaatctctatcccatcaaaacagagtttaataactggtacgaatgcctcttcaacagctcttaaatcttttacttcttcctgtaatttcaacttatcatagaatgaggtgaaaaagtcacttcgatcaacatgtcttggtgcaacacacaacgcatcaatatcagcaccttgctttcactgatttctcgtatccactcttttaccaggttatttagttttcccaaaattaaaatcctgcgctgcagttgctcttcctcttcagaaaccccaaagggtttcaatgtctcaattagtttctgtgtaagtacgcagtcagtctcccttggggctgcttagctgatacgagaagtaatgccataatgcttctgtggcagttgtgtttgttgtgatccctgtgttgtaacctggaacgg

SEQ ID NO: 594 - DNA, 498 bp, Homo sapiens
agcttgtcctctatgacttacccagaaggcaacgcttctctttctggtcaaaatggctggtaagcagggcgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcaggtgttatgaagatggttaaacttgaaacaaacaattttaagaattatttggtctgaagatgttttactttaaataaatgtcta

SEQ ID NO: 595 - DNA, 682 bp, Homo sapiens
ttttccttcttaatgggaaatttatttcctgaagttggagccacagggagtgtaagaggtactgtggttccaccatccatgctgggtccagctcctctgaagagctattccaagaggtcctcatctgagtcatcatgataaccacttttattagtgtgggaggctgtgtccaaagcatccacaccatccacaccattggcctctgcatgctgctgcagcacagagtatcgatgcaccaggaaccttcccccacagacatatttcttcacaatgagcactcctgctacgactgtgaccagcatcaatcccacgatggccaggataattggaacagaatttgacttggaattctgtttttccggactcaaaaagttgcttgtgcatttctttttcaagtcttttacttctcgaactggatttaccccaccctggcatttgtcccctggaattttccggtacccatttgttgttaggtgttcttctcttccgtacagacaaaactccaggtcgtggcccttcagttctggctgttccacacacttggagtcattttctggacggtagtagccaaaatcacagagaaagtcctccagggaacagaggcagatggagggctgctggtcacaacatagtctctaccattctgacacacggatgacttgcgtagccggagaaactcctc

SEQ ID NO: 596 - DNA, 793 bp, Homo sapiens
  misc_feature 508, 579: n = A,T,C or G
ttgcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgtggtttttgttttttaaaaaaaggcccccagggcaagttatttacagtttaattgccactgtcaactgatctggaccttgatcgggaccgggacctctggcgatccacagatgctggagacttagatttacttagagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacctactgtgccttttgctgccttcaattaattntatttttctcccatttatttcctttccagaaagttgttcaatagcattctttaagtcaccataagaggcanactcaaccaccccttcatttaatttaggtcggtgtgcatccgcaaacgttacttccccagcttgtctcatgacatctttgagatgcatgcagctgactctcgaggataaatgctcaactataagacgattgtctgtgcttacaggtggagcattccgactatcatgtcgaggtctgcgactactaaaaccgacacgagatcgtgctctacctct

SEQ ID NO: 597 - DNA, 2437 bp, Homo sapiens
ctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaa

SEQ ID NO: 598 - DNA, 1980 bp, Homo sapiens
atcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccataaaaaaaaaaaaaa

SEQ ID NO: 599 - DNA, 1679 bp, Homo sapiens
ggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaaaaaaaaaa

SEQ ID NO: 600 - DNA, 1517 bp, Homo sapiens
gtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaacta

SEQ ID NO: 601 - DNA, 1199 bp, Homo sapiens
caaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgttctgcctgaaataccatgattgtttatggaaagtatctttaataaagctggatacagtttggcttggaaaaaaaaaaaaaaaaaaaaaaaaaaaaaaaaaaaaaa

SEQ ID NO: 602 - DNA, 999 bp, Homo sapiens
  misc_feature 999: n = A,T,C or G
tactaacaggtgaaatgtacaaggtgtctgtgtgttgggtgtagcttcagagttagattgaaattaccaggcacagatttagtcttgtcatttgtttacacatggggaaaacaattcagtttattaaacgtttcatgtaactgcacccaagtttgccaagctggaaacttggaccttttctgtgtagtgactttttaattatagttttcataacctggagatcagactgttgctttcgcatgatgtatgtagtgtctcatgactggagttgcttgttttatagtatctgtactccttgtatttttcaagagctatttgtaaacagatgatgtatttctccattgaaaacacaataaaaaaaaaaagcacaaaaaaaaaaaaaaaaaaaaagaaaaccaaacaaaaaagaaaaaacaaaaagaagccggcgacccagaaaataaaacaaacaacagcaagcgccatattaattaacacggacgacaccaagcattcgtgaatacaagaacggcggcccccaagtcatagttacatctataaggagaccaggaccagggtcgcaccaccaaacaacacgacctgacaagggaaacaacaccaatgatgcgtagaaatattggcgcacgcacactacaccaccgttggggaaggcacacatcacggcacacaacacaaccgcgagagggtactacccacgcgtcgggagcgcaacacaacactaccgctgcgagggcaagagtagacacccccacgcgtcaataaacggcgagccaaacaaatcacaatcgaaagagtaaagacaaacaaaaacgccgagcaagaccaaaacagcaagacatagaaaagaccgatcaacaactagaagcgacgaacaacccaccgcctccagcacaacaacagaacaacaccgaacatagatgcacgacaaccacccaaccaaaccacccccacttctgcgccacacccaacacacaacacgaaataacacataccgacacn

SEQ ID NO: 603 - DNA, 3316 bp, Homo sapiens
cttggggtggggaccgggtgaggggcctgacggcagagtcggtccagaactgcccggacagcgacgcacagcgaggagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcaggaattcctgtctctgcacctgcttagaacatggggttttgactttaaactcattcacatgagtattcattatctctcctagggggtctgtattgtcaaaccagactctaggggctttggccccaaggcgtgaagggggttaagaagggaaagcataagaagggaagctgttttggggtgtggggcctccccagcctccctcaaggaagaccacacatgcaggcatcagtcagctatccttgcactcagtgaggatctgcaaggaggaccctcccaaatggagggcatgcttagaagctgctctagattggagaagaggtggcaatgatgagggggaaagaaggagaaaggaaagaaaaacctagtttcactcctccccttcttccatgtctcctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagttgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggagcgcccccaccgcaccccccagacccaagcctcggggcccgcagctctcaccgcgcatccctggccggagcgttccaagggccgcccgaacccaccccgcgccgcggtcggggttgcggcgccagactccctcccaggcgcgggaggcggacgccctctggtggaggcgggggaccctggcgaggactctcggcggcggcggcggcgcgcacggcccaggggctgggcggggcgggaggctgggcctcacccccactagctgcggtgtaggtccagctccgcggctctgagaccagcgtttccgacccggcccggaacaggggagactggactcgaccgaactgaaggaagggaccaaacctcggtgaactctgcaaccctctcccgaacactccttgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccagcgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggaaaaaaaaaaaaaaaaaaa

SEQ ID NO: 604 - DNA, 586 bp, Homo sapiens
gtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggaaaaaaaaaaaaaaaaaa

SEQ ID NO: 605 - DNA, 5067 bp, Homo sapiens
gcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggactccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggcctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggagcctgtgtgaaatgcagcaaaggggtgtttggggctggccaggcctgtcaggccatggggaacctctaccatgacacatgcttcacctgtgcagcttgcagccggaagctgagaggaaaagccttttattttgtcaacggcaaagtgttttgtgaagaagacttcctgtactctggtttccagcagtcggctgacaggtgttttctttgtggacatctgatcatggacatgatcctgcaagccctggggaagtcctaccaccccggctgtttccgctgtgtcatctgtaatgagtgtttggatggggtgcccttcaccgtggactcagagaacaagatctactgtgtccgagattaccacaaggtgctggcccccaagtgtgcagcctgtgggcttcccatccttccacctgagggctcagatgagaccatccgtgtcgtgtccatggacagagactaccacgtggagtgttaccactgcgaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgacttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctccgtaccccttcaaatccttactctcctaaaggcagctgagtccgcgacagaaatttgccctatgggagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccaactggtcagggcagagtgatcgtaactaaaggtcagtggggaatagatccgattcagtgcttttgccttatgcatttcagcatcctggctccccagggtggcaggagctgaggaagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctaacattgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcggtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttct

SEQ ID NO: 606 - DNA, 842 bp, Homo sapiens
  misc_feature 309, 497, 546, 559, 569, 590, 591, 613: n = A,T,C or G
gggggttatggtattaattcattaaaggatcggcaaccaccattgtatccatttctggatcctttccaaaatatccaaatcctacacttacagaaacacaacagacctaaggaaatgaagcagcttcaggctgcgaggatgaagacaccattgctgaagcaaaggtctcctcctagagggatagccaggatccatcacagtaaacccttttacccccattttataaacatccaattattaactgttcctgctgggttggagtgtaagatgagaccaaatggagagatgtctagtagaagccccactggnggtaacctgcttaacattaaaaaaaagacaggctcagttctattccctggacccacatctgtaggaattatattatacagcaccagtcttaaatggtgttctgcttcagattcatgcatacctgaatgggttgaatgacaatactgtacaagtcaataaactgtatcacaatacaacttacacagttntgtaaggttgaataaatactttctgtgccagttaaaaccatcagcaganactgaagaaacanactgacattngctactacattaatcaatgannagtgcaccatctgaacttgatntgcccatgacgttgaaacacacagaataacactgcacatcactgaaacttctcttccatcactactctactacttgatataagtctgatactagtgttatgtcaagatgtcatatcgagctattaatagagcaaatcacatttaggcataaagagctattagcactataagtctatctagactgaagtgcttgacactatagaatttatataagaatctttatctacga

SEQ ID NO: 607 - DNA, 3222 bp, Homo sapiens
gagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaaaaaaaaaaaaaaa

SEQ ID NO: 608 - DNA, 587 bp, Homo sapiens
gggatgagtggaggatgggatgagtggaggatgggatgagtggcgttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 609 - DNA, 1799 bp, Homo sapiens
cggacgcaagatggcgacggcgaccatagctctccaggtcaatggccagcaaggaggggggtccgagccggcggcggcggcggcagtggtggcagcgggagacaaatggaaacctccacagggcacagactccatcaagatggagaacgggcagagcacagccgccaagctggggctgcctcccctgacgcccgagcagcaggaggcccttcagaaggccaagaagtacgccatggagcagagcatcaagagtgtgctggtgaagcagaccatcgcgcaccagcagcagcagctcaccaacctgcagatggcggctcagcggcagcgggcgctggccatcatgtgccgcgtctacgtgggctctatctactatgagctgggggaggacaccatccgccaggcctttgccccctttggccccatcaagagcatcgacatgtcctgggactccgtcaccatgaagcacaagggctttgccttcgtggagtatgaggtccccgaagctgcacagctggccttggagcagatgaactcggtgatgctggggggcaggaacatcaaggtgggcagacccagcaacatagggcaggcccagcccatcatagaccagttggctgaggaggcacgggccttcaaccgcatctacgtggcctctgtgcaccaggacctctcagacgatgacatcaagagcgtgtttgaggcctttggcaagatcaagtcctgcacactggcccgggaccccacaactggcaagcacaagggctacggcttcattgagtacgagaaggcccagtcgtcccaagatgctgtgtcttccatgaacctctttgacctgggtggccagtacttgcgggtgggcaaggctgtcacaccgcccatgcccctactcacaccagccacgcctggaggcctcccacctgccgctgctgtggcagctgctgcagccactgccaagatcacagctcaggaagcagtggccggagcagcggtgctgggtaccctgggcacacctggactggtgtccccagcactgaccctggcccagcccctgggcactttgccccaggctgtcatggctgcccaggcacctggagtcatcacaggtgtgaccccagcccgtcctcctatcccggtcaccatcccctcggtgggagtggtgaaccccatcctggccagccctccaacgctgggtctcctggagcccaagaaggagaaggaagaagaggagctgtttcccgagtcagagcggccagagatgctgagcgagcaggagcacatgagcatctcgggcagtagcgcccgacacatggtgatgcagaagctgctccgcaagcaggagtctacagtgatggttctgcgcaacatggtggaccccaaggacatcgatgatgacctggaaggggaggtgacagaggagtgtggcaagttcggggccgtgaaccgcgtcatcatctaccaagagaaacaaggcgaggaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaaaaaaaa

SEQ ID NO: 610 - DNA, 1726 bp, Homo sapiens
cgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggcacttacctgggtctggcaaaccacggacagaccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaaaaaaaaaaaa

SEQ ID NO: 611 - DNA, 605 bp, Homo sapiens
gaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggccttgctggctactgggtgttagtttgcagtcctgtgtgcttccctctcttatgactgtgtccctggttgtcaataaaatatttcctggc

SEQ ID NO: 612 - DNA, 1081 bp, Homo sapiens
cagctattgaggtcttcgaatgctgcggastggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccggccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattattggaatttaaaccatgtcacagctgtgaagatctggcacaagatagaatggtaaaaaaaaaaaaaaaawtttwagtkgydgtkcctwgtttkggygktcctttmatkkttwwtttwatagcygtgggtccagtaatgatmcttttttgywggggggrgkcyaggggggttmgtttyccvaaatamctaawtt

SEQ ID NO: 613 - DNA, 659 bp, Homo sapiens
  misc_feature 39, 200, 201, 228, 241, 254, 259, 264, 270, 271, 285, 294,296, 304, 306, 307, 308, 310, 333, 341, 352, 360, 367, 371,372, 379, 399, 424, 427, 432, 434, 438, 439, 452, 460, 462,467, 469, 470, 471, 473, 486, 488, 495, 496, 506, 509: n = A,T,C or G
  misc_feature 513, 519, 539, 564, 594, 617, 618, 619, 623, 648, 656: n = A,T,C or G
ggaattttttttttttttttttaattgaaatatccactnggctttaaataacagatacaaaagaaagacagtttggatcagaaagtgctgtgctttctcttttgttaagaaaccagagagccactgaaatttccttggaaactacttgttatttgtggttagaactaaataacttacttgcccatgtaccagatgcagannttctttcctgacaacctatgccatttncactgtagaaatngaacctgtgccanaaagncacangtactnnaaccatgaaatctnatttatccntnaaaacagncnnntntgggcaagaggacaagggcaagnggcaattnagggggagtgnatagtttnccggacnaggnntctgttnttccaggggttcacttttgncttgaggagagcttgattgtgcctngcnccttnantcgnnggtggcaggcggnccccgttncntacgntnnnancggggtttgggtncnacttttnncttaggctantancggngttaanaggattggttaaaaacacanacggaaaaaaaaaacaaaacaaacnaaaaagggataaaaaaccaaaaaaaaaatnaaaaaaaaaacaaaaaataaaannnaaanaacaacaaaaaacaaacaaaaaacnaaaaaaanaaa

SEQ ID NO: 614 - DNA, 3938 bp, Homo sapiens
tgagcctgtcaggctgggcgggtccatatccgggtggaccgggtgggtgaggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacaaaaaaaaaaaaaaaa

SEQ ID NO: 615 - DNA, 503 bp, Homo sapiens
tttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtcctggtaaagtaaaacaatgggtccctggatagactctcaagagggcctttgatggaatggaaccagtccccccaccccgaaagcatccccccagctcaacatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctca

SEQ ID NO: 616 - DNA, 583 bp, Homo sapiens
cgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaacaaaaaaaaaaaaaaaaaa

SEQ ID NO: 617 - DNA, 2075 bp, Homo sapiens
cccggccgacagccccgagacgacagcccggcgcgtcccggtccccacctccgaccaccgccagcgctccaggccccgcgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcttccccagacactggtttgaagaatgttaagacttgacagtggaactacattagtacacagcaccagaatgtatattaaggtgtggctttaggagcagtgggagggtaccggcccggttagtatcatcagatcgactcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtcttggcaggctgatttctaggtaggaaatgtggtagctcacg

SEQ ID NO: 618 - DNA, 4460 bp, Homo sapiens
agttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaaaccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaattag

SEQ ID NO: 619 - DNA, 3333 bp, Homo sapiens
acgcgtccgagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaaaaaaaaaaaaaaaaa

SEQ ID NO: 620 - DNA, 826 bp, Homo sapiens
tcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaa

SEQ ID NO: 621 - DNA, 982 bp, Homo sapiens
tcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgaaaaaaaacaaacaaaacaaaaaaaacaaaaacaaaaaacacacaacacaaaacaaacaaaaaccacacaaacacacacaacaaagaaagtaaaagaaacacaacacacaaaaaaaacgaaagctcacacacaactatactagatccagaaaacaggaaggaggagcagccagaggcggcacaacctacaagaggagaccgaacatcaagcagacacaacgcgcacgagtacacagacaagtgatgagagcttaccgaattgaggccagtacaggaacacgccagggcggataaggcaagacaagaataagaagcggcgcgagagcaggggaacggcaacaggacgaacaaagaaaagagggaagtcagaacgagagagaagaaggaccgaacccggtgatcaagaagcaggcgcaaagccgagcggcgagaccgacagcccgacaagaagaacaagagagaggacaacgagcgccgacagaccaatcacaaacatcaggccgatgtgtgtcgagaacacaaaacaagcagacaggagtaggccgcaag

SEQ ID NO: 622 - DNA, 765 bp, Homo sapiens
aggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccaaaaaaaaaaaaaaaaaa

SEQ ID NO: 623 - DNA, 4268 bp, Homo sapiens
gccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgcattttaaaggagtcctttgttgttatgctgttatccaatgaacacttgcaagcaattagcaatattgagaattatacattagatttacaattcttttaatttctattgaaactttttctattgcttgtattacttgctgtatttaaaaaataattgttggctgggtgtggtagctcacgcctgtaatcccagcactttggaatgtcaaggcaggcagatcacttgaggtcaggagtttgagaccagcctggccaaacatgtgaaacgctgtctctattaaaaatacaaaaattagccgggcatggtggtacatgcctgtaatcctagctacttgggaggctgaggcaggagaatcgcttgaacctgagaggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataa

SEQ ID NO: 624 - DNA, 2918 bp, Homo sapiens
gggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtt

SEQ ID NO: 625 - DNA, 413 bp, Homo sapiens
  misc_feature 1, 3, 4, 296, 310, 385, 397: n = A,T,C or G
nanncatttatttatttatttttaaatgcagagtccactaatgggtcatggcccaccatgtaaaaaacactagttattaaagtgacactggggatgtgaggtgtgacctcacgaagaagcaaatttaatattataatgggaagcatccaccaggccgactttgcacttagaactgcaaaataagtaggcatcaggttcagggttgaaagtgaccagcacagagctccacagtccacattacctagggataggaaaaaagccagccgattcaacattcttatttgtcattacaaggntcaaaggttaaaantgggcgcctttcaaaactgggggaaaggctttctctctttcaggatcccgatttacataggtttgtttttcagcnggtaataattcntttggatatttcaggg

SEQ ID NO: 626 - DNA, 439 bp, Homo sapiens
ttttttttttttggttataatagctatttattaccataatgagaaatgaacaaaagttttacagtgagatgacaaagttcaaatattatctgtagtatacaagaactagataaaaaaaaaaacacatggtgcaaaaagggtgcctactatttaaataccctatacctgagttacaaatcacctaagcacaattacaaataattcagcctagcacccatgcaggacactggctagtacatgggtagccagcagagcctcttagcagaggcaaaatcaattgcatttcaaggaaataagtctcccagcatcagaatgcagagatggattctttcctcccctcacttggtccctaattgttctctttacaacactagcagatgttggggctcagaaaacccaaagtgaaggcctcagaagcaaagtttttctctgatgttat

SEQ ID NO: 627 - DNA, 309 bp, Homo sapiens
atggcaaaaatctccagccctacagagactgagcggtgcattgagtccctgattgctgttttccagaagtatgctggaaaggatggttacaaccgcaatctctccaagacggagttcctaagcttcatgaatacagagctggctgcctttacaaagaaccagaaggaccccggtgtccttgaccacatgaagaaactggatgtcagcagtgatgggcagttagatttcccaaaatttcttaatctgattggtggcctagctgtggcttgccatgactccttcctcaaggctgtcccctcccagaagtag

SEQ ID NO: 628 - DNA, 3286 bp, Homo sapiens
tagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaaaaaaaaaaaa

SEQ ID NO: 629 - DNA, 1204 bp, Homo sapiens
gtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaagcctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgctaaaaaaaaaaaaaaaaaaaaaaaaaaa

SEQ ID NO: 630 - DNA, 566 bp, Homo sapiens
ttgaatttaggtgacactatagaagagctatgacgtcgcatgcacgcgtacgtaagcttggatcctctagagcggccgcctactactactaaattcgcggccgcgtcgactttttttttttttggttaaccaattgagctttgagtgttctaagcaggacaggtaagatctgcgtctggcacagtcagccaggtctccttaccctgtgcttccctttctgcctgtgactgaatgggcatgtcagggtctagtaggggatccaggaggaggaagcctcattaacttctattctgcagcaattgatagacacccaacttgaacagtgggggcttatcgcctcatatactaagaccagagatagctgatgccaaggttggctaaattagtagcttgagatgttagatttttcatttgaggtttctatgctgctgttgtcttccgctcttggtcacagaggctgccacaatccgcatgtcaagtcctcatgtgacaatatccagacacagcaaggaagaggtagagtcgacgcggtcgcgaatttagttattgtagtcgacccgggaaaa

SEQ ID NO: 631 - DNA, 1435 bp, Homo sapiens
ctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacttgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacgg

SEQ ID NO: 632 - DNA, 459 bp, Homo sapiens
tgtacaaaaataccagtgcttgttatactagttactaaaagaagaagaaactcaaaattcctatctgcgtgctaatttgaaaagaacaacgtagatagatttgttggcacatatatatggcatattcacatatggcatatatacatatggggagaaaacatgaaccaaaggccaattcagttatgggagctcatctccttccatctctcctaatcaagagcaaagggaacagcaggcctaacagcagggttgggaaggcaaaaggactggcactgaactaagtgaaagggcgtctggtctattcagaggaagaggctggaatggcttaacaatagcaggcatttataagtgcccaccctcaccaatgcatcgggggtggtccctagatatgaaaggtgaggaagtctctgcatactgtgatggtaccacgggctgcttcaattgtaaggcaaaggaagc

SEQ ID NO: 633 - DNA, 671 bp, Homo sapiens
tgcctggccacaggcttcttccccgaccacgtggagctgagctggtgggtgaatgggaaggaggtgcacaatggggtcaacacagacccgcagcccctcaaagaacagcccgccctcaatgactccaaatamtgcctgagcagccgcctgagggtctcggccaccttctggcagaacccccgcaaccacttccgctgtcaagtccagttctacgggctctcggagaatgacgagtggacccaggatagggccaaacccgtcacccaaatcgtcagcgccgaggcctggggtaragcaramtgtggctttacctcggtgtcctaccaacaaggggtcctgtctgccaccatcctctatgaratcctgctagggaaggccaccctgtatgctgtgctggtcagcgcccttgtgttgatggccatggtcaagagaaaggatttctgaaggcagccctggaagtggaattaagaacttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctga

SEQ ID NO: 634 - DNA, 1542 bp, Homo sapiens
acaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatctatgtcaaatttttccatctttcatccagggctgactgaaactatggctaataattggggtactcttatgtttcaatccaatttaacctcatttcccagatcatttttcatgtccagtaacacagaagccaccaagtacagtatagcctgataatatgttgatttcttagctgacattaatatttcttgcttccttgtgttcccacccttggcactgccacccacccctcaattcaggcaacaatgaaattaatggataccgtctgcccttggcccagaattgttatagcaaaaattttagaaccaaaaaataagtctgtactaatttcaatgtggcttttaaaagtatgacagagaaataagttaggataaaggaaatttgaatctca

SEQ ID NO: 635 - DNA, 491 bp, Homo sapiens
ttattcaatcaatttttattgagcacatcctacgcacaagacacaatattaggtacagaaaagctataaagataaatgtgacacattctttaccattaataataatatatattatctaaaatttaatttgagctaatatataactgacaatgaaatatttggaccacctaaaacaaggataaattattctgtgacaagtttatattcttgcattatgcaaaaatgattctaaaataaactatttttttcccagaaattgtatgagctatacattgctatgtaacaaattgccccaaatttagcggcgtactacaacaaacacttcttatctcatacagtttctgaggatgaggaatccagaatggtttccttgggttttctggctgaaggtctctcatgaaattacggtcaagctattagacagggctgcagtcatctgaaggcttgactgaggctggaagatctacttctaaaatggctgttgacaggag

SEQ ID NO: 636 - DNA, 2267 bp, Homo sapiens
gcataggctaggtagcgaggccgcgtgtgaatcggccgaggccgagtttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtc

SEQ ID NO: 637 - DNA, 640 bp, Homo sapiens
  misc_feature 493, 580, 631: n = A,T,C or G
ttattggtactaaagcctttactgtaataaaccaaatatatttacaatttatacaaatgtttaaccttcaacaaaaatacaaaaaaacatttcacaagatgcaaaaccaggaaacaagttcattggagacaccactgctctacaaaggacggaaaagtgaggtgaactgcaaggaacagaaaggtaatctcacacttgggcaaggcgtgatccccagatcacccagaaagaaagaatgggctgtcatgtgagtcggcagattccgttcctcaatcctacaacccatggcccctctgtccgcttggccttggtgctccatttggtctatgtagacaggtgactttctgctgatggacttgtcgcctcctctttgtagactcaaagtagttttctgtcaaggtttggaacaggtgtttgtaattttttttctctttaaagttacaacttttctatttctataaattcgaaacattttggcccaattcaactatanacgttaaaccacataatgttttcagtagatgacttcatagactgtagccttcttgtcccccgagccagtgactatgtactatcatcncacagagatgcacagcttagcactggcgaggactctttggactggaaatgntcgcttcat

SEQ ID NO: 638 - DNA, 591 bp, Homo sapiens
caaaacactaccctccttctccttcagcatctgttgtgtatattctgccctcacatctctgccatgatttcttagggaaacgtgtatattgtaaaataagcagattataacgtggtgccaaacagaacatctgcttctatcctcaaagcatgtatttaacttattcatcctctgcattagaaaataaaagtgcagcttatgttcaaaaagtacaactcatacaaagcaaggtttaaaagttctgtacttagtgtaacctttcaaaggtttgtcttgattagtataaattcagactctgcttacccattgactataagtaactgttttttgttttcaagtctttagatgacagatcatgctggagtagatgtgctcttgcttgcataaagacagctgtgctatggcgtttttttttttaatctcaaaagttaacgtgattcaagagagtggttttgctaaacaaactgaagcacactcgtcattacattaaaaggtaagaaaacaattctgagagacagcaagcataaagggcccagaatcactgtgcgaggccacaggtcaactcacccagcggacatatgtacaccagtg

SEQ ID NO: 639 - DNA, 469 bp, Homo sapiens
  misc_feature 321, 352: n = A,T,C or G
tttttttttttgggagcagggagaactttattgaggttatgaatatattctacttgaaactggaaggataagtggtcatgaatttgtggcttatggtaacctttgttaagcatctttctttttctttttttttttggtgagacacagattcactcttgtcccccaggctggagtgcaatggcgtgatctcggctcactgcatcctctgcctcccaggttcaagcgattctcgtacctcagcctcccgagtagctgggactacaggcatgtgccaccatgcccaagctaatttttgcattctcagcagaggtgaggtttcangcacgttggccaggctggtcttgaactcctngaccttgtcatcctcccaccttggcctcccaaagtgctgggctcacaggcgtgacaaccaacggccggctgttatgctcatcatggcacttaagagatgctcaacaaacctttccta

SEQ ID NO: 640 - DNA, 458 bp, Homo sapiens
  misc_feature 399, 442: n = A,T,C or G
ttttcttagagagcatatttctttattctatttttatcatgcaggaactgaatcagcaggcaggatactgctcttctccccaacctcccccatctaaaggagatgagattttgggacataggtacaaacatagtggaccataggtacaaacatagtggacagggaactcagtggtcttgtgggctacagcattaaccacagcatttgttagttactgccaagaagcctgtatctgtagggtaaaatcctcgctgaagtgggttgccaaaacaatcaatatcacgttgcctaagagcaggaagttctcagggtccacgtgcagcttgttacagtgcaggtcactcagtgtagcaaaggtgcctttgaggtcatccgtgagcataacagcttttccgaagnggattcagcaccttcttgccatgtgccttgactttggggttgnccattattggcacagt

SEQ ID NO: 641 - DNA, 363 bp, Homo sapiens
ttcttccggagtttgccacttgcatgagactgctctgagggcactgtctcggtgtcatctccatccgtcttgctctctgtgtttccacgctgaccccttcctttgttccctggtgccacagcgtctgtgagcgcacagccagacctctccccgttcaccacagggtcatcctcaagatcgtcaatgtttatcagctcgaagcggttgttgactcggacgccctccttccctgcgcccccgggacgccggacaccaagctcccgcttgggcccttcttcttccgcgtcatcgtcatcacggagatcgaaatgcaaggcgccgggcccgaggggctcctggccgcgctgttcccccctcagcctc

SEQ ID NO: 642 - DNA, 570 bp, Homo sapiens
  misc_feature 499: n = A,T,C or G
ctttctttaactaggttataagcatattaaataagccaggtaaactccaagcaccttactttcttccatataaacacagctttccttttgccgcaagcatctgatgacgactgggcctacatacgtaaaaacagattatagcacatctggacctggttgacataatgaggcatccagattggttcatgattatttttgcagctacacatttctcaatctaaaaaaataggctacagcagcccaaattcactgtctcagccttggtggggcataatattttggaatggcaagtgccaaaaaatttaaatgtactgggcaagcctgctttgtgtagttgactctaatgcctttaaaaatactggcatgattttttatattcaagaagtacagctatgaaattttaaaataaaattacatgaagttttttaatattccaaaccacaaaacagatctgctatgtggtagactttttaatagcctattggagatttaactctgntacgccaacatcttctttaaagtcatgctttgaatttgggctccaaataattaattagaagggggggaaat

SEQ ID NO: 643 - DNA, 794 bp, Homo sapiens
gagtcccctgctgaaaaccctccagtcagcgcttatcccttctgctctctcccctcacccagagaaatacatggagtttgaccttaatggaaatggcgatattgatatcatgtccctgaaacgaatgctgggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgacaggggcttctaatgacccaggatatggaaacagaagacaaaattgtaaggccagagtcaaccaaattaaataaatttacccccttcctccaaaaaaaaaaccaaccactccaccaaacacacaaccaacaccgtgtgtgcgccggccctgcgcccacgagaaaaaaagttctcaagaaccactccggttggggcgcgcgccgcagtagtaataatggccaaccacggccaagccgggcgccaggcaacccggtcaaggacacagcgctggctcccacccaaaaaaaacgccgggcgaacaacagacggtttgagacactcagaggctccgggggaaacacggcactaccacaggggcaaggacctaataatacccctgccgaagtagaaaaatcgagggaacacagagaaa

SEQ ID NO: 644 - DNA, 506 bp, Homo sapiens
agacaacagtaatttatttagctcctgattgtgtgaatgggcaatttgggctgggatctgcttgagtggttcttctggtcttgattggcctcattcatgtgttagctgccatgttggttgggctagtatgacttcagctaggaaagcatgtttctgcttcatgtggtctctcattctccagcatgctcactcaacatgttcatggctgggtaaggttccaacagacatttataaggcctcttgaaacctaggcttggaactggcatacagtcacttcttccacattctattgatcaaatcaagtcacagtgccagcccagattcaaatggtggggaaagagacttcatttatggaagggaggagctgcaaatttcattgccaagaggtgtggatacccagaaagatacatttgacaaaccatctatcaaagttactgtcagaggtatgtttttggaaatatcatttggagtgggatgtgtcctgtatgactggaatcgttttctat

SEQ ID NO: 645 - DNA, 1907 bp, Homo sapiens
ctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaaaaaaaaaaaaaaaaaaaaaaaa

SEQ ID NO: 646 - DNA, 2719 bp, Homo sapiens
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcggcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgctgggccccaagccggctctgcctgcaggtaccgaggacaccgccaaggaggatgcggccaaccgcaagctggccaagctctacaaggtctccaatggtgcagggaccatgtccgtctccctcgtggctgatgagaaccccttcgcccagggggccctgaagtcagaggactgcttcatcctggaccacggcaaagatgggaaaatctttgtctggaaaggcaagcaggcaaacacggaggagaggaaggctgccctcaaaacagcctctgacttcatcaccaagatggactaccccaagcagactcaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacagatctggagaatcgaaggttccaacaaggtgcccgtggaccctgccacatatggacagttctatggaggcgacagctacatcattctgtacaactaccgccatggtggccgccaggggcagataatctataactggcagggtgcccagtctacccaggatgaggtcgctgcatctgccatcctgactgctcagctggatgaggagctgggaggtacccctgtccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgcccatcctcctcgcctctttgcctgctccaacaagattggacgttttgtgatcgaagaggttcctggtgagctcatgcaggaagacctggcaacggatgacgtcatgcttctggacacctgggaccaggtctttgtctgggttggaaaggattctcaagaagaagaaaagacagaagccttgacttctgctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtgaaaaaaaaaaaaaaaaaaaaaaaaaaaaaaaaaaaaaaaaaaaaaaaaaaaaaaaaaaaaaaaaaaaaaa

SEQ ID NO: 647 - DNA, 1678 bp, Homo sapiens
aagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaaaaaaaaaaaaaaaaaa

SEQ ID NO: 648 - DNA, 2492 bp, Homo sapiens
gcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctaaaggagtcttcgcgaagttttcagtgctctgtttgcaattcttccttcagttcagcatcgagttttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttaaaaaaaaaaaaa

SEQ ID NO: 649 - DNA, 1651 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttt

SEQ ID NO: 650 - DNA, 6511 bp, Homo sapiens
gaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttaaaaaaaaaaaaaaaaaa

SEQ ID NO: 651 - DNA, 1442 bp, Homo sapiens
gccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaatgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttctgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctcatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaaaaaaaaaaaaaaaaaaaaaaaaaaaaaaaaaaaaaaaaaaaaaaaaaaaaaaacctcggg

SEQ ID NO: 652 - DNA, 4254 bp, Homo sapiens
ggggactacccagagggctgccgccgcctctccaagttcttgtggcccccgcggtgcggagtatggggcgctgatggccatggagggctaccggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacaatgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagagggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaagtgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtctgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggctctgggctgacaaattaaaacctagagtagtgcttatgctgaaatgatacttttcattttttggttgatttttttgccttcccttcaattttaaactgaagcattttaatgtgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagcgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaacgtagaagaaagaacattattattctttaattcctacaaggtacttgaaaaccttaagtgaaaaagatttctatctttttatcttggcgcatttatggaaaaaatattaactgtcctgaatattttataattttgtaggaaaaatatgcatctattttttcttgacttcttttatatagtaataaaagttattttggaaaaaaaaaaaaaaaaaaaa

SEQ ID NO: 653 - DNA, 2529 bp, Homo sapiens
ccgccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaatttttt

SEQ ID NO: 654 - DNA, 633 bp, Homo sapiens
  misc_feature 157, 306, 328, 417, 450, 478, 501, 506, 512, 523, 567, 575,583, 613, 620, 622, 623: n = A,T,C or G
gagcacagctatgttttgagttcttaagcaagggcaagcttaccaggcacttacagagaaggttgacgaggatgacagggaactaattgggggagggatgccatggttgaaaacatggctggggcagcgagaagttaagatgaagtcccaagagtcngcaagaacatgcagttccaggacgtgattctctgcagggacaaagagagacagcagctacaagtctataggcagtgacaaaggatctgagatcccatcagagtagacttcaagttggagaaaccttttattggcacaggcattccttgntaacttgacagggtgaagctgnaatttttcaaaaacagtaaaagctcggtttctcctaaactattctccctgtggtagtagagatcagttgggtcagaaacaactcctgancacttgggttccctttgagccgcgtcataaggnggccatctgtaaaactagcacaggtctncccctgttccactggctcacccncatgnttagcngagtgcacganaaataaacttctttttaaagatcatgctgagacaagatcagagngttgttgnattgcaantcggttagatgcaggggcctgggagaaggngtctccnannggtcccacac

SEQ ID NO: 655 - DNA, 491 bp, Homo sapiens
tttttttttttttttttggaaaaccttaccatgttgaaaactttattgtggagtctctaaagagagagaaacttaccaaatattaatatgatggtcaagacatgaatttgtatgtatagaatgattacaattatgtagaaaaatacaccacacactcgaggcctggggttactggacacgggtcatttcttccctgactacatcatggattccggtccagaacttccagattgtctacaaaatgcctatcttcatttttttcacaaaaaaaaatttaaacaaacacaaacaccccacccccctcctccaggtgctcttatgaagatcaaatgaggtattgatgtgacggctctgggtctcagtttcctcgtctgttaaatgcatatgagaattatctaaggttccttcctgcccttctctgggggacacaggccaggaggagaaccttgcatacaacccctcatttttcagaagaaaaaactgagaactca

SEQ ID NO: 656 - DNA, 1657 bp, Homo sapiens
cctaagagtcgcgctgtaagaagcaacaacctctcctcttcgtctccgccatcagctcggcagtcgcgaagcagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcaacttatcacaggcaaagaagatgctgccaataactatgcccgagggcactacaccattggcaaggagatcattgacctcgtgttggaccgaattcgcaagctggccgaccagtgcacgggtctccagggcttcttggttttccacagctttggtgggggaactggttctgggttcacctcgctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaaaaaaaaaaaaa

SEQ ID NO: 657 - DNA, 5084 bp, Homo sapiens
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttgccatactttgtctgaaaaattcctttgtgtttctattgacttcaatgatagtaagaaaagtggttgttagttatagatgtctaggtacttcaggggcacttcattgagagttttgtcaatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 658 - DNA, 718 bp, Homo sapiens
ttttttttgttccaaaggaaatcagtagctttattatataggtatatgacttttacgagaagttaaagagtttccatctgaaggacagaaattgttaagaggtaacgtacagacctcaggcaccacatcatttaccctccaataatgaacaacatttctccctaaattcttattgcaccttaacctctccagcatcaaatcttctactctataacctctctttaaacacctccctctaatctcaatttccttctgtttttattatttggcaaaattacgcttaaaaaaataaatatttccatcatggcatatatatacctatgtaacaaacctgcacattcggcacatgtatcctgaaacttaaagtaaaaaaaaaaaattgtgtcattaaaccagaggataaaataaataaaactcaagttaatttgccacgtagagctgtgtggaagtgaggaaggtgctcttacataaacaccctccggcttccacactcatatgtatctgcttcctggtaagtctgaggttgggggaactgcaccttacttttcctctcctatatcccctagtgcggcaatatcagaacccaaaggaggaaaagctggcaaaggtgtcatgtgccaagcggccaattcctactgaaatgaaggaggttcactccgtctctcctaagcagaaagagatgtccaggaaataatatttaaaaagccattcgagatcc

SEQ ID NO: 659 - DNA, 1651 bp, Homo sapiens
ctgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccacagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatataacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggc

SEQ ID NO: 660 - DNA, 971 bp, Homo sapiens
aggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgattt

SEQ ID NO: 661 - DNA, 1295 bp, Homo sapiens
cacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcg

SEQ ID NO: 662 - DNA, 1169 bp, Homo sapiens
attttcgtttattttcttaacatataatgaaattccaactccaaagagacatatatgcagagcagacagacgccgggccttggtgtgcagcmgcctagaaccaggcagggggtgggtgtgacccctctcccctccatcacaactctccccactcctggcccctggccattgcccaggcagaaactgagaagctggaaatgagaggaatcagcctcgtggtccagggagtagccagagacagggccttggttactaggcctggccaaatcattgtctagctgaaaccgtgggcctcagtttctttatctgttaaatgagctagaagttcctgctagggaatggagaagagagtgtgcagatgtkatgcactggtgatagttaagggccttctggttgtccctctgcttctaaatacctgcgtwattgtgtctcttggtttctgttgccatcatggctaagtgcacagtggtggagctgctctggccctggtggaattgaaaggacttatgtagatagaatccagccttcaaagctgatcctgatctctgaactgtccttgggctgcaactatagctacctcattaggtcaaggctgacctctcccctccaggtcaatgcagagggaaggctgtggccaggggtcatacagcaagcctgtgcaggttattcagctgctcaaatgcctctgatcaggagctcatgagcgagggaagagcttgctccatcctggtcaggaccagctgagggcttggaaaacccccaggcccagcaagggcatctgcctccatgggctgacctgcatcagggtctttctgtcctcaggctttgggcttcagacagctcaagtgctctttgataaacatacaccagcataatggtgacctgtgtctacactgacaagagggagtagagaactgaagaatgagcgagagaatgcagtkatagatggaaagaccaactaaaactcagagaagtaacaggggtatttctccttcacccctaaatggsttcattckgcratagcrggccskgtgtagggragcgtctccatagggamaaaaartcsaatacctgkctgtttttgatctcktcgttttasckktctccckcvcrmatttcmmagagcgkttgcgaaattatcccctggggaagamaaaggsaattgaaaa

SEQ ID NO: 663 - DNA, 703 bp, Homo sapiens
  misc_feature 651, 669: n = A,T,C or G
ttttttttttttttttttttcaagtttttttgttaggctttccactcggatgttgaggtcctctgcaggtctctgatctgaccatccactaggctcctgaaaggaagtggcatggcctgcactttctcctcctgttgcagtatctgactttgtatcaaaagtgggtggtatctcacaaagctctgcatttctggactgaaagttttcacaagtgttgttaggttcaaatgacccaaatggaggtgaacactgaactttctgactgactgccatttgctactgatgtttcactttttagcaaatgcatctgtcggaccttgtgaattcttgtaacaagttcatctgcagaaacacttcctgctattacttccaagggaattccactgtctccaataaaaaaactggatggaacacacactacaggatagatttgtgaaaactgtaggcaggcttcacttttggtatcgattttaatagcaacaaaactgtttgaagatgcttctgtaactttatcatcttcccaacttgcagccatctgtgtagactgttcatcatcacctgccacgaacaccacgaagaccgcgccgctcctttttgccgtcgcgatggcggccggaatggcgcccctggaccacagcatcgctcccttcnggccccagcgctcgctcngtgtgtagtctccgagtccccgagccgggtctcg

SEQ ID NO: 664 - DNA, 815 bp, Homo sapiens
tgacatttggtatctttcatctgaccatccatatccaatgttctcatttaaacattacccagcatcatgtttataatcagaaactctggtccttctgtctggtggcacttagagtctttgtgccataatgcagcagtatggagggaggattttatggagaaatggggatagtcttcatgaccacaaataaataaaggaaaactaagctgcactgtgggtttgaaaaggttattatacttcttaacaattctttttttcagggacttttctagctgtatgactgttacttgaccttcttgaaaagcattcccaaaatgctctattttaagatagtttaacattaaccaacataattttttttagatcgagtcagcataaatttctaagtcagcctctagtcgtggttcatctctttcacctgcatttaaattgggttgctgaagaaaggaaagaggaaagcaaatacgaatggtactattgtaccaaatctttgggattcatgggcaaataattcagtgtggtgtattattaatagaaaaacaaaaaaaaaaaaattgggggggtcggggcctcgagaagtttctaacccattccgtggcggcggggccctgaggtatgaaactggccaactgtcccaaaggaatcgggtaggcaggtcgtcccccaaaaaacgcgggaacggggtttcgaaaccatgggcgcggctcggttcaaagggtcgcagcgaacccccgccgcggtaaaaacaagagaaacaaacacaggacaagagaaagagaaaagaaagagaagaagagagaacgcgaaacaccatg

SEQ ID NO: 665 - DNA, 532 bp, Homo sapiens
tttcattatggttctcggtgtactttattctcctgctgtctagctaagcagcccacacaggacagaaatgggtagcactgaggaatgatcagattttttttctatccccaatatttctgccccctccctaagccctgacccaaccctatcttaataatcacgaatggttagtacatcattctgtctctcaaagaacaactgaaatggaaacaaggcattagaggaccaggcctcttcttaatagggcttaggagctggtatgagctctttattcacaatggagcgtctctccttcaaatacctggattttttttttttgtacactggttcatagatcggcacttgactttgaacctggcaccaaaaggcacaatatctgataccctgtacaagagctattagagatgctgccatatggatgggcaaaactgagccaatcccacttaggaatggaaggcttggacatggaagggaggatataaacgaggagttggagaaaaacgcaagcccagtttttgctagagtggaaatg

SEQ ID NO: 666 - DNA, 1074 bp, Homo sapiens
gatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactcaaaaaaaaaaaaaaaaaaaaaaaaaaaaa

SEQ ID NO: 667 - DNA, 1098 bp, Homo sapiens
ggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaaaaaaaaaaaa

SEQ ID NO: 668 - DNA, 9449 bp, Homo sapiens
gaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcacgtgagaacaatctggcaacaccgcaaggtccggctgcatcagaggctgcagctgtgtgttttccagcaggaagttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcacgtgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaaatatcagctccttttaaaagagctgctgacgtgctgtgaggaaggaaagggagagattaaagatggcctggaggtgatgctcagcgtgccgaagcgagccaatgacgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggaccactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcatcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgccaaggacggaggtcgcattgctgtatcacagtattttttacggatttctgaaaaaaaaaaaa

SEQ ID NO: 669 - DNA, 484 bp, Homo sapiens
acttccttcactagttacgacaaaatttaagaggaataacaaatacaaattttctgttaagaacggaaaggtgcaaactagcagagtcaatactggtaaccagaaggcactaatccaaacacataaatttcaaaagctggttatattatggaataccatatatactggcctttgccagtttgggatttctgcaatagcaataagcctcgtttctgtttccaattataacaacaaaaagatgagttactaatgaacattccacttacagaagtctaggctatgttgataaattgaaaacttatctagactactctgtctaagagcaataaaaagtaaacactcttttatccagcagcactaggaaacagggtgaatttaccaagataaattaggttggggatacctactgccaacttgtgcggttgtcgaattcactgtaatatgtattcctcttattgatagagctctgaatgtaaacaaccta

SEQ ID NO: 670 - DNA, 1482 bp, Homo sapiens
cggaagcggcggagtagagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggaaaaaaaaaaaaaaaaaaaaaa

SEQ ID NO: 671 - DNA, 533 bp, Homo sapiens
ctcataaacaggaactttattaaactacatgttacataaaagaacatataaatggaccattaaatacattcagtttattttaaacaaatttacatagatacttatttacatttctccattgtattcttaaattatttttccaagcttactaccgataaaaggtaatacaatgatcatctgctcacacagatgcatagagaagttgtccacagggctaagtaaagcaccacttcccaggaaacacagcttattagatcttccagcaacaactcatgctgaaggtgctctcttctgagcagcccttgaggtgaggcttttgctttagagatgctgggggttggttctgaggagctgacccagggcagagatgggtccttgctgattgacctgacttggactcacgaggtggaaagacctgtggagaacatcatcgaaggcatggcccacatctgtgatatgggaaacaggcttggaagaagtggtgatttccaaagtacccagcttcctgatagaggagggcctgagccttgttc

SEQ ID NO: 672 - DNA, 3686 bp, Homo sapiens
gaattccgattaatcctccagttggttgtccctgccgtctcggaagggttagcacacagccaggtctgtttttgatgtatgtaattgaagatttataaagaaaagcttctcctctgcctcatccacagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgcaccccctgcaggcaggggtggccttgactaacccgggcccctcaaacccccttcacccaggccccagaacagcttactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtacgagaaggtggcccggcgcacaggggcacccatcatcgtgtccaccatgcttgcaccagaaccaagtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccttcaacagggaggacctggagaagttcaaggccctgagagtgatcgtgcggataggcagtggctatgacaacgtgaacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctgggtgacctctttttgctaataggaaaatcacattactacaaaatggggaaaaaactgtttgcctgtggtagacacctgcacgcataggattgaagacagtacaggctgctgtacagagaagcgcctctcacatctgaactgcatactgagccggaattc

SEQ ID NO: 673 - DNA, 676 bp, Homo sapiens
  misc_feature 542, 550, 563, 626: n = A,T,C or G
gcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagaaacacaagacctgtaaacatcagttgctttgggaacacaagaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccncaccattntgagggcatattnttaaagcaaaaaagtatgctttattgttttaattaaatgatagcctagactgacatatatatntacactatacatacccctaaagtcctatattgctacttctggctcgtgcc

SEQ ID NO: 674 - DNA, 529 bp, Homo sapiens
gcaaagtctgagcaaaagcagtaacatctaagagaactttctttcctctcaatcatgtgcattgaggaagcgctggctcacgtggtcaacggagtgtgcctcaccaactgggcagtcctgctgatggctgtgtgatcccgatgcagaagccaactgagcagaagtgcagtgagtgagtctcttactatcctaaagaaaggagaagaaagacgaccaactgcacactttccagctcacagcaaagaatgggggaggcagtcaaagtcaaatgtttctctctccccagtcatcctgctcaccttatttaaaaaaaaaaaaagtataatttgggaagaactgctttgttcaaggtgccacaggggcaaaagtggagtcatcgctatttctttctttctttccacatgtattctgaagggaaagttaagtaactggagtgcagaattccaaaggggcaaatcctaatgctcaaagtaaaccagattcacacccttctgttagcaggggagagaatggttttaagtatagtgca

SEQ ID NO: 675 - DNA, 654 bp, Homo sapiens
ggatgccaagttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccacccaaccatcttggctaaccttaaattcttcagggctagaatatgttcaccccagaggcttagatgaagcacatttgcggctactcgggcagatggtctcttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccactgcccaggcatcagccttgctgtagtcaatcactgccctggggccaggacgggccgtggacacctctggggccatcaaacagccgttttcgccccgatccacgtaccagctgctgaaaggcaactgcatgccgatgctctcatcagccagacagcaacccaaatctgcgatcaccag

SEQ ID NO: 676 - DNA, 418 bp, Homo sapiens
ttttaggttgttctgacaaaaactgaaaagcctggtggacaatttctaaaagagctgttaacactgccaaaagcatttctaatttaaccatgaaattgtacccggctctaagtcctcactacaaactccacatatctttatatgaacatgaggataagattacaccaagatttaacttctcaagataaaagattaactaaagaacaattccgataccttgtactaagtactaggaacacaacaaccataagtgactatatgatacttatgctcatgaacaccctcaaaaatcttttgtttcatcactcaataacaaaataacttttgctgaaatcattaaaattagctcagtaaaaaaacaaatgcacaaagaagtacaaggatatttattttatagcattattagtagtaacaaaag

SEQ ID NO: 677 - DNA, 572 bp, Homo sapiens
catggttacttttttatttgaagaaaaaaaaaagtatgttttaataaatactgcggaaacattgaccaaacaaacatacacagtgacttcaacagtttaaaaaatgcaacaaaagttctgctttataacagttataacttattttctttttacaatatttaaatacagaaagcactcgccagctattttgtaatactgcccaaagcataatgctgcatcaatcaaagcatattatgttggtaaaatgtctgtattttatgggaaatgactggaatcgaattttcttgcagagacaagacaaagtgcttgtaagacatagaactgagtgttgtaattaccttaatctctcctgccacgatttaaggggagcacagcttcaacacttcaaaaacgaagcactatcatgggaaagaaagctcgttttcaacaagcgccaacaataaacaggtcagatctggtttcttctctgaaagaatctctaaaaggaactggtcaaaaatatctgtaaactattttaaatgcttattattttacgtaacaacagagaccaagtgctgaacacagaccttggc

SEQ ID NO: 678 - DNA, 6704 bp, Homo sapiens
gtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtcaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggctgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctgcggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccagcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcaggtacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggacgctcaggacagtctcaagatctggttcaacaacaaaggctggcactccatggtggcctttgtcaaccgagccagcaacgcaatcctccgtgctcacctgcccccaggccgggcccgccacgcccacagcatcaccacactcaaccaccccttgaacctcaccaaggagcagctgtttgaggctgcattgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggcttattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtgaaa

SEQ ID NO: 679 - DNA, 1323 bp, Homo sapiens
gtggaggttgctgctatgagagagaaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcaaaaaaaaaaaaaaaaaa

SEQ ID NO: 680 - DNA, 416 bp, Homo sapiens
ttttttttttttgggtatttttacatatttattaaaacaagtttcctgagaagtttgactaggctatgttgttgttaacctagtttgcttaaaatgtacgaaaatgcaatcaaacttacatatcttttaaatattcgaaagtcagattttgttctgattgccctatccaattagggcaaattagtgagggtttttttgttttttgttttgtttttctaacaatagtctgaaacataaaattaagtttgggtttaaaaacaattcttgaaactgtcataaacatatgatatctattgattaaacagtaataaaaagacacaaggtacaagaattgaggcttggctgttctggctgtatactaacttcatataccctgacagaataaactatctttttaaaaagtgctttgtacactg

SEQ ID NO: 681 - DNA, 1648 bp, Homo sapiens
ggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaaaaaaaaaaaaaaaaaaaaaaaaaa

SEQ ID NO: 682 - DNA, 991 bp, Homo sapiens
ttttattgtctcaaaggggcagggctgagggagggagctgaggagcaacatccccccaggccccaaggacacacacactctgtccttcccatgggccatggctctgggagcracccaaagaagggagaggaggctcaaactgcccccaggccccagggttctcaggtcagggagttagggaggaamatgaaagtgacatgcttcttaratamatcagcggctgtaacmacagggctgagggggcctccttgctctggagggggtcttcgtccatccttggtgggggggggtgcccagccccttttcaggcctaagaamagtctctaagagggtcaggagaactgggcagccgctaggacagcgtactamaccccggacaggcaggtgagccacaggcttgtcamarammaaataaaaaaaaacgcamaaaaacgcgcamamamamamacamamacacaaagagtgcaattgagagccttgggccaggacgctaraagatagggatgtagttgtcgattttggcgcggtggcgctgggcgatacattcagcgatccacacgatgttgcgacactcctgctccttgagcttcacgaaggcataraagacaccaaagtggaactggttcaggaaggccaacttgttcagctttacctcgtgctcaaagaatcggtcctccagcgtcttgtctccagggttgctacctgcaccctcgaagagcagcttgtactccgggtagtaatcggccacgttcttgacctgttcatagtcgtcagcccgagccagctgcgccaggccctcagggtagagccgcccacagtgtggaaagagcttggcacggtcctctttggacagctctgtgccgaaagaattgatggtgatgatgaaggcgcggcggtctgcttcaaactccaggatggggcacatggcatcagccgtagtcccgcccagtagggtgcagaacttgtagaaggactccaggtaggscttgta

SEQ ID NO: 683 - DNA, 5855 bp, Homo sapiens
agttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatccaaaaaaaaaaaaaaaaaa

SEQ ID NO: 684 - DNA, 1880 bp, Homo sapiens
acaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggttgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttaaaaaaaaaaaaaaaaaa

SEQ ID NO: 685 - DNA, 3407 bp, Homo sapiens
tgcaggtgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccggacaggtaactttgacatccacgtggatgaatggaagagaagactaattaggctgctcttgtaccattctaagcaggaggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgcaaaaaaaaaaaaaaaaaaa

SEQ ID NO: 686 - DNA, 399 bp, Homo sapiens
tttttttgtcttaaaaatgtttcatattttaatattgttaatcttccagttgggtttactgcatataatctcattccttagtacatgtaatatgatcaatttactacaatgcttatgaggaatgcaaatggaattagtttacagaatgaaagaatgttgcatataattccattttaatacagaatttataaataaaatcatagtttatacttatagcatttcttcatttttagtgtttttttttcaagtgggttaaacagatctgtgagtaccttgagagttgtcatgtagaataagatgctaagagggcagagtttgggattccctatgtaacttcagctacaacagccttgctttatccattgtattcattcagcaacaaataggtatttgtgggcc

SEQ ID NO: 687 - DNA, 4597 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagccttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 688 - DNA, 1542 bp, Homo sapiens
ggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgtta

SEQ ID NO: 689 - DNA, 714 bp, Homo sapiens
ttttaatgatttatttgcaagtatgagattgacctgaaaaacaatgaaacacatgaacacacttccgattttctcctcgctgattagcttcctgcctgctgtcagtgctggacgaagtgctataactactttatgtaacattacagaacagctagaggtcctggggtaagagaaaaaaagcacatcacaacaaatgtgaaagccttcattattacacgttccagttgtctcgctgtgtaggcataagctaatggtttattttcagaaagctgcctgaaacgtgcttgtattcttctaggaagaactttaattcctcctgaggaactctactttctgagccaaactgctaattttctgcggaactgtctagaagatcattcaagagaccctgcagttgcactttctcgtaaaagttacaaaaaaaaaaaaacaaaggggtttccccgggcgttttggaaacaatttgggccatcatgaaaaagttggacatattaatttaagaactggggtttggacaaactttgtaattagtctccaagtattgtaaaccatatttcgcaaaaaagctaaagacttgtgccaacaggttcgtgccacttagagcactacatttaacctgggtacagcaaataatcacttctgggaaacaagtgtggcacgtcctttattgtgattaacaatatgaaaggccatttggaattaacaggggtgtag

SEQ ID NO: 690 - DNA, 4452 bp, Homo sapiens
cgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtggggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcattttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttataaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactc

SEQ ID NO: 691 - DNA, 1497 bp, Homo sapiens
gagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcag

SEQ ID NO: 692 - DNA, 834 bp, Homo sapiens
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagatttcttgggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttga

SEQ ID NO: 693 - DNA, 776 bp, Homo sapiens
gcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcaaataacgcctgtgggggcagaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccggagcctgcagccatgcgaccccacgccaccccgtgcctcctgcctccgcgcagcctgcaagcgggagacccttgtcccgcccccagtcggtctcctggggtggacccctagtccactacagatttacccaggttcacgccagaaaaaaaaaaaaaaaaaacctcgtggccgaattcttttgccctggagggccaaaatccc

SEQ ID NO: 694 - DNA, 2188 bp, Homo sapiens
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaa

SEQ ID NO: 695 - DNA, 10244 bp, Homo sapiens
gcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcaaaaaaaaaaaaaaaaaa

SEQ ID NO: 696 - DNA, 3780 bp, Homo sapiens
tactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggcagctgtcgccattttcttcgtcatcaccttcctcatcttcccgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaggagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactctgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttgtattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgcatgctgtagtgacatcctttataggcaccttacagcttaaaacttttgtttcatttcatgccttacttatcagaaaggcaggaaagtaggtatgatctctaaagtaaaaaaaa

SEQ ID NO: 697 - DNA, 712 bp, Homo sapiens
agaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaacaagaacgaacgataacgaagaaaaagaaaaggagacaaacaggacacgaacacaagagaaagagaagaaaaaaggacctagcaaagccactgttaaagctatgcaagaagctctggctaaagcttaacagaggacagaagacagacagaaagagagaagaggaagaacgtcataaaaacggcttgaagaattagaagccaagcgtaaagaagaggaacgatggaacaacgaaaacagagaacaggcacacagcaaacacagaaaaaagaaaagaaaagaccgcttgacagaaaacaaaaacaacag

SEQ ID NO: 698 - DNA, 964 bp, Homo sapiens
gagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaaaaaaaaaaaa

SEQ ID NO: 699 - DNA, 683 bp, Homo sapiens
  misc_feature 589, 603, 659: n = A,T,C or G
ttactggcatcctgtacatttacttttaaaaaaggataacaaaaatgaatattaacaaaaatccgggacaacaatattttcaagcaacaaaaactggggtggggaagcttattctgaaggtacatttaaaactgaaataacaacttaatgaaaattaagaattgcatagcgctgtgaatttagccttcagcaaaacaaaacagaagctatttggtattgatacaaatccatctatttgatagttagtcatccaatattatgtacatattttatatactgaatgtcattttaagtcctgttttccaaactccatttttctgttgctgggtttttgttttttgacaagttaaacactttctggcactttctatgacagaatttcttctgaacatacatgaactgacattctcccaaagcgtcccttgtgagtggacgtgcctttctgctacatatcgttcatttgttacaaaatgaaataatccacagtgcgatgtgtctgggtccaccgtgcacagcaacatccaggctaaaccaggctggaccaaaccttctcaggccaggttcttctgcctctctctcctccgctctncagagtccaaactntccagctggtaaagcttcagaaagcataaacaagcaaccatggttaaagccctctntgtccctgcaccgccgagattttt

SEQ ID NO: 700 - DNA, 520 bp, Homo sapiens
taaatggaaagaaaatatccctagtcagaaataaactgacaaatttacattctcctctcttaaaaaagtaaataaaataacattattcaaaacgtgaattagctatagacatacaatacaattacatagatacatatcaatacagcacattcaatctgccaaaaaattaatgattacaaagccagtatggatgctgcaatatcaagagagatgtatgtacaatgattagagcatttgtaattgcactatacctacaggcagtctgtttgttaaattacaggtactttctgagcaagggaaaaaaaaagtaagctgtgttggttgagggctggagaatcaaggatgagaacatctcattactgttgggcggctttggtactcatttaacaggccgtgatttttctccctccccctttgttgttccaaaagagtgatttatatggaagtttacactagtgccaaataccactgtagttaaaatgagaccagtatcatggcctaattctaacgtcccagcagc

SEQ ID NO: 701 - DNA, 1290 bp, Homo sapiens
cacacccatactcagcccctgcaggcaaggagagaacaggtcaggttcccgagagctcaggaacatggagctgatccaggacacctcccgcccgccactggagtacgtgaagggggtcccgctcatcaagtactttgcagaggcactggggcccctgcagagcttccaggcccgacctgatgacctgctcatcaacacctaccccaagtctggcaccacctgggtgagccagatactggacatgatctaccagggcggcgacctagagaagtgtaaccgggctcccatctacgtacgggtgcccttccttgaggtcaatgatccaggggaaccctcagggctggagactctgaaagacacaccgcccccacggctcatcaagtcacacctgcccctggctctgctccctcagactctgttggatcagaaggtcaaggtggtctatgttgcccgaaacccaaaggacgtggcggtctcctactaccatttccaccgtatggaaaaggcgcaccctgagcctgggacctgggacagcttcctggaaaagttcatggctggagaagtgtcctacgggtcctggtaccagcacgtgcaggagtggtgggagctgagccgcacccaccctgttctctacctcttctatgaagacatgaaggagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctgg

SEQ ID NO: 702 - DNA, 424 bp, Homo sapiens
attgaatttaggtgacactatagaagatctatgacgtcgcatgcacgcgtacgtaagcttggatcctctagagcggccgcctactactactaaattcgcggccgcgtcgacttttttttttttttttgcttcttttaatagctagtgattttgagatgatggggtttctgggaggcattgggaacctttaagaattctgttaacttttagaactttaataccagatgggatcagataaataaatagttgtaggtagaagaattcccagagtaggtgtattagtgttaggtgcaggataaactatggggcccttccagtaacaggacatctggatgtgatcggtttttttttttttttgagacggagtgtaactctgttaccaggctggttgacggggacggtaaattaatagtactagtggtct

SEQ ID NO: 703 - DNA, 771 bp, Homo sapiens
agagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagaaaaaaaaaaaaaaaaaaaaaaaaaaaaaa

SEQ ID NO: 704 - DNA, 2067 bp, Homo sapiens
ttcaaattcacttattctagtagtttgtagattcctttgaattttttatgtctgtaatcatagaagcattctatgcttgtgcagataaagcatttttcagtgttaaaagttttattgacttctttttctggagtttccatcttctcattttgtcttctccttttggtatcaagtgctaagaatagcaccacttggaaatatgacaggactgcagccagtgtggataattatcattttcaactacagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttg

SEQ ID NO: 705 - DNA, 527 bp, Homo sapiens
ttttaagagtcagtatttattctgattaatattttacaaaattttgacatttaatttatgtaaggagggctaatttattaaacactttacaggtttttctttccacagaataacacggtaagtagcaaaataatacttggcacagttataaataaagaaaatataaaataaaaacatccatagcttaagtacaatgatgctgttttacgcccattaatatcaaataaattcctggaaacaacaaaaatatgaatgaaaaaaactccaaggaagtaattcatgttcagtgctgagaattaagttcctatttgctaaaagtatccaattaagttgataagaactattcccaaaggttcaccatcatacacaactttagaactgggtttatagttggttccacacacaggacctacaaaataattaaacagatggtatactgctgcatagctggctcctgaccatctgaccatttctgagttatagatttcacaggtactacaagatggttactacaaaagcattcacat

SEQ ID NO: 706 - DNA, 2887 bp, Homo sapiens
ggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaaaaaaaaa

SEQ ID NO: 707 - DNA, 514 bp, Homo sapiens
aaaggaagcttccctttgctaagtatcaaatacttgaaatgtgtgctaatgtccacagtctttactttggaaaaacaaaaacctgtcagccaagtataccaatcaccacaacaaatggcaatatttaaatgatccattttagaagtgggagatgaaaaaactatctcaaacacaaaatcatcttcgtatcacggataagaacgatccttaggtctacatgaccctcctcattttaccaaagaacattatatgacccagtgtttaagccgatcagggacacctggaactcagcaaagagaggtctgttggctgcctgttctttatccataaaaggatgctgctgccaacaactgcgaatgaaacatgcttccttggcatccactctttgacacggcgtctggttcatggtgaaattgtctaccaaaaaaatcaacacacaaccaagcccaaagctgggtatgcatgagatgggccttatcatcttgttatgctacaaagtacaaaagtgctacaa

SEQ ID NO: 708 - DNA, 1633 bp, Homo sapiens
cacgagggggacccgggccgcgtgggcgccgggatggagggcgccaaggggcggggagcgggcgtgcgtgtgtgtgcgagtgcgaatgcgagggaggccggccttgagtgaaaccggagctacaaagaaggggagagtccgggagcgggagggcgcgagggaggagcggcggctccggggcagctccgacgccctcccgcggggaaggagcccccgcggtgccgccgaggccccgacgcggggccgcccctcggctcgccgccccgcgcccgcgcccgctgggaatgatgaagaagaacaattccgccaagcggggacctcaggatggaaaccagcagcctgcaccgcccgagaaggtcggctgggtccggaaattctgcgggaaagggattttcagggagatttggaaaaaccgctatgtggtgctgaaaggggaccagctctacatctctgagaaggaggtaaaagatgagaaaaatattcaagaggtatttgacctgagtgactatgagaagtgtgaagagctccggaagtccaagagcaggagcaagaaaaatcatagcaagtttactcttgcccactccaaacagcccggtaacacggcacccaacctgatcttcctggcagtgagtccagaagagaaggaatcgtggatcaatgccctcaactctgccatcacccgagccaagaaccgtatcttggatgaggtcaccgttgaggaggacagctatcttgcccatcccactcgagacagggcaaaaatccagcactcccgccgccccccaacaaggggacacctaatggctgtggcttccacctctacctcggatgggatgctgaccttggacttgatccaagaggaagacccttcccctgaggaaccaacctcttgtgctgagagctttcgggttgacctggacaagtctgtggcccagctggcagggagccggcggagagcggactcagaccgcatccagccctccgcagaccgggcaagcagtctctcccgaccttgggaaaaaacagacaaaggggccacctacaccccccaggcacccaagaagttgacgcccacagagaaaggccgctgcgcctccctggaggagatcctatctcagcgggatgctgcctctgcccgcaccctccagctgcgggctgaggaacccccaacccctgccctccccaacccggggcagctgtcccggatccaggacctggtagcaaggaaactggaggagactcaggagcttctggcagaggttcagggactgggagatgggaagcgaaaggccaaggacccccctcggtctccgccggattctgagtcagagcagctgctgctggagacggaacggctgctgggagaggcatcatcgaattggagccaggcaaagagggtgctgcaggaggtcagggagctgagagacctgtacagacagatggacctgcagaccccggactcccacctcagacagaccaccccgcacagtcagtaccggaagagcctgatgtgagggcagggtggggtctggaacttgtcgggttggacagactcttatctccgtgttgctggataaagcttttttatttacctcaatcaaaaaaagaaaacaaaaatgaaaaaaaaaaaaaa

SEQ ID NO: 709 - DNA, 512 bp, Homo sapiens
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 710 - DNA, 2840 bp, Homo sapiens
gtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccagcctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaaaaaaaaaaaaaaaaaa

SEQ ID NO: 711 - DNA, 2950 bp, Homo sapiens
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattggtcaaggacaaaagctgtattttgtctgctctctgtatatctcccgaggagaagactgatcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttg

SEQ ID NO: 712 - DNA, 582 bp, Homo sapiens
  misc_feature 524: n = A,T,C or G
gtggtggtggttgttcatagaagagtgttctttataaattatattattattgtattttttgaaaaatttatactagaaagtggtatatatgtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcanataatgcttatttatactaaagatgagtttatctgatagagttaggaaatttcttctt

SEQ ID NO: 713 - DNA, 640 bp, Homo sapiens
  misc_feature 613: n = A,T,C or G
atattaacaaaaagttttttttttttaatcaaagtacataaaataaaggtggacacaactgtaagtgatcaccaaccaggggatgtttgggatttttagatgcattaaaagagagtatagagaatatccacctgcaagtaagattgtattcttttgcaaccctgcgattttcaaatggcaccccaacacagtctttggtcaggataagggatcctgcaggcctagccttaccgtccacatcaaatataggtggagggatgccatattctccacatttggagctctgtcaggctgctccctttccaccagtcctatccagtgatactgcagacaaagggtgaggcaacaggagacatcataccgatgttgatcaggagaggaagaaggtgcaatcttacttccaggatttcacatttggaagaatgccttgggagtggtgggtagcccaaggtgttcccaggaaaagaagcaggcacagggccaggactcaggctccattttgacccacgtttatgtccttttaccacatgtcattttggttagaactgcttgtgttagtttccacattaactcaaagctgtaaataatcacctactcctaataacatcagcantgtggccctaccactaccagttggtag

SEQ ID NO: 714 - DNA, 4366 bp, Homo sapiens
  misc_feature 2332: n = A,T,C or G
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttcttcgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagnttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat

SEQ ID NO: 715 - DNA, 282 bp, Homo sapiens
atggagtttgatctgaatggcaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatttctgagttgccctaa

SEQ ID NO: 716 - DNA, 848 bp, Homo sapiens
aaatggtttcacttgctcttgactgtcagcaagactgaagatggcttttcctggacagctagaaaacacaaaatcttgtaggtcattgcacctatctcagccataggtgcagttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaaatggctttcataacactaactcataaggttaccgatcaagtgcatttcatacggatatagacctagggctctggagggtgggggattgttaaaacacatgcaaaaaaaaaaaaaaaaaaaaaaaggagaaatttgggtatttttaacccgttgagtttttaaaaaggttggaggcttttttaattggggacggctgttaagccttacattaagtacgtgagtattaggccaacaggtggattaaatatgtggggtgttattccctaaggactggaagtggacatattgtggacttattcaaggtgtaagacctgtagtgttcctcaccacagtggggaccaataagagggcattggcccctataaatagtgtgcggaaaggccaggtgtttatcaagcggggacgattatcttgacaaggtggcctctaaagggaatattaatagtggcagccgcgagggatgtgtagcccttcacgtgtcccattataagaggggaagtccatgtgaagggagaccctgttgagaattagagggtttaattc

SEQ ID NO: 717 - DNA, 1209 bp, Homo sapiens
cgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaagaaaaaaaaaaaaaaaaaaaaaaaaaaaaaaaa

SEQ ID NO: 718 - DNA, 2963 bp, Homo sapiens
ggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcaggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggattctgatggcaattactgtctcattagtgaacaataaaagaaaaattgttgtattagcacaacctactactgtgaagaggaaaagaattaccccatacaagtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttaaaaaaa

SEQ ID NO: 719 - DNA, 526 bp, Homo sapiens
aacctgcaaactctttattaaattctcccatttcatctgtacagaaaaaaatgcacattatgttcagaacatatctcagtaacatctcaaaattacacagcatgaacatgtaaaaacaagggaccaccacgattttatacatagaaaggaaacccatttacaaaagaggcttgttaattgtatttttttctttctttcaaaaacaaaacaaaacaaaaaaaagtgaaaagcctaagatctcacacagcatttgctgtacagactgttttccggatggactggtttgggaacactgtgctgggggaagctgcccaggaagcgctcccgctgccggctttccggaggtctctgcccagtgcactgcagggggacctggagggcccatttctaccaccctagcatgtctgacagaaagccctgctgggctctggggtccagatgtcaactctacattggaggaggcaaaacacaatctagaggcactgtctgaactttcccctggcccagggagatttctccactgcac

SEQ ID NO: 720 - DNA, 167 bp, Homo sapiens
gcgtaggccactatcatggaaggagactctcgtacaataataaacagccgtgtcctcagttctcaggctattcatttgcagatacaacgtgttcttggtattgtctctggagatggtgaattggcccttcacggagtctgcataatatttattacttccatcatatg

SEQ ID NO: 721 - DNA, 2194 bp, Homo sapiens
cctcgtgccgagcgacccgggcaagcgacccgggcgcggcgcggggaggctgaagggacgctcgggtaggcaagcgtttgcctcagcatggagggcggggcctcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaaaaaaaaaaaaaaaa

SEQ ID NO: 722 - DNA, 551 bp, Homo sapiens
ttttaaagaaacacacacacatttattttaaaatttgacataatccttgggtaattattagcatttttcagaagtttccgagactgatatctcaactccaaaccaatagcaatagcttatttgattggtggaaggattagagagggtcccatgatccagatgaatagatggctatcaaagaagacagaaccccatagacacaggcagcattaagtcataatttttaaattaaactgtcacaaatatgaaacatctcaccagaccaatgataacgtccatatcataatttgcgttttaccaaagtgtccacatagacagcacagaactaaaagttctgtagacttcagaatcatatttaaattaatttgatcctttatattaataataattaaaaactagattctacccagtgtcgtcccagtcttcacaccaacatgtatgtcctgctgtcggaatgccacctcctctgcactcagtgtcatgattcgaagattaaaatcagtgtgtcaaatcagaacataaaccaagccaggaattcatgggcccagaga

SEQ ID NO: 723 - DNA, 1966 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccgctgctgcccggagcaggaggagggggagagtgcggcgggcggcagcggcgctggcggcgactccgccatagagcaggggggccagggcagcgcgctcgccccgtccccggtgagcggcgtgcgcagggaaggcgctcggggcggcggccgtggccgggggcggtggaagcaggcgggccggggcggcggcgtctgtggccgtggccggggccggggccgtggccggggacggggacggggccggggccggggccgcggccgtcccccgagtggcggcagcggccttggcggcgacggcggcggctgcggcggcggcggcagcggtggcggcggcgccccccggcgggagccggtccctttcccgtcggggagcgcggggccggggcccaggggaccccgggccacggagagcgggaagaggatggattgcccggccctcccccccggatggaagaaggaggaagtgatccgaaaatctgggctaagtgctggcaagagcgatgtctactacttcagtccaagtggtaagaagttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcagcttttctgggagaagaggctacaaggacttagtgcatcagatgtaacagaacaaattataaaaaccatggaactacccaaaggtcttcaaggagttggtccaggtagcaatgatgagacccttttatctgctgttgccagtgctttgcacacaagctctgcgccaatcacagggcaagtctccgctgctgtggaaaagaaccctgctgtttggcttaacacatctcaacccctctgcaaagcttttattgtcacagatgaagacatcaggaaacaggaagagcgagtacagcaagtacgcaagaaattggaagaagcactgatggcagacatcttgtcgcgagctgctgatacagaagagatggatattgaaatggacagtggagatgaagcctaagaatatgatcaggtaactttcgaccgactttccccaagrgaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacaaaaaaaaaaaaaaaaaa

SEQ ID NO: 724 - DNA, 1654 bp, Homo sapiens
caaacaaaaaaaaagcattctaaatccttcataaatattgtggttaatataatatattaaacatttagattttaaagcacaaatgcttgttaagtaaacatattcaattatatcatttctagaaatattccagatctaattctagaagagttctgtccaatagaactttctgtggtaatggaaatgttctgtatgtgtgctgttcaatatggtaaccacatttgctgttgagcacttgaaatttgggtggtataatagaggaactgaatttttaatttaattttaattaacttaaatatccaagtgtggctagtggctacctaactgaattgcacagttctagaacataattgtcatggtgtgaacatagtctgctataacaacccactctccacaaataattacaaaattgtatttctttggtaagatttggtgtagccctcacagttcaatattgtgtcctttggctaaaagcaaggtacaatgcacatgccgaaagaccttagttttggatgtgatgaaatgttttctatgcctggaataaatgccttcctttgggttgtaatttcttaaatagtattgctcctctttctgtgagttatttaatttttttctctgtagtagctatgatttctggttttctagtgtgatcatctattgagtaagaaagactaatctcatttggttgtttttgtttttgtttttaactgtccctattttaaaatatttagatgctaattcttccttttggcagtttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagtaaggatttatagatttttttttttcttttttactagaaagattcatattagaaaactttgggtaaagaaaaaaaaacttcatgtttgatattttttcatgagattggctttttaaatcaaagatgtaaataaatccagccactgtggtgcccgcctgtaatcccactactttgggatagcagatggagacaggaggattacttgagcctaggagtgcaagaacagcccaggcaacataatgatccccagctcacaaaaaaaattagctgggcatcatggcacacacctgtggtcccagctacccggggggctgaggtgggaggattggttgagcccaagaagttgaggctgcagtgaaccatgattgtgccactgtactgcagcctgggtgacagattgagaccctgccttaaaaaaaaaaaaaaaaaaaaaaatgtaaataagccaggtgaggtggctcccagcaccttgggaagccaaggtagaaggatcgcttgagcccaggagttcaagaccagcctgggcaacatagggagaccctgggagaccctgtctcagcaaaagttttaaaaaattagccgggcatgttggtgtgcacctttagtcccagctgctcaggaggctgaggtgggaggatcacttgaacccaggaatttgaagctgtagtgagccataatcatgtcactgcattccatcctggacaacagagtgagaccctgtctctctctctgtctctaaaaaaaaaaaaaaaaaa

SEQ ID NO: 725 - DNA, 946 bp, Homo sapiens
cctggaaccaatggggttgggagggcagcttcaatgttttaaaatgtttcaggccaacagaatatgcttataaatgcttttataacctcatagcttctgtttctttatagtttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatattggaaaaaaatacaacaatgcaaaataatacaaatttaaaaaaatacaatatatttatgtggtgtttacatgtattcgttattataagtaatctagagatgatttaaagggacgggaagatatatgtaggttatatgtaaaatataccattttatataaggaacgtgtatatccatggatttagaatctgtagggattcctgggaaaccagtcttccattggataccgagggatgactgtatgtctgtgaaatttgtccagtactattgttgttggttgtttgggcggttatggttaattcttaacatgggtcaccactttctacgattgtggggaccgcttccctgacatatactccgtaaagtctgtgccccttgtcggcaacggtcggtcactaaacattgtgaatatttccgcaaaaaagggaacccggcaagaggccaaaggggctgtccaaaaaaggataacaacaaggagagattaaaccagagggtaca

SEQ ID NO: 726 - DNA, 705 bp, Homo sapiens
cgacacgtacactgcttgaagagtcctcttctattactaaacgtttttattgtgcaacatttaaggcatacaaaaacatataaagaataccatgatgaaaatctatgactgtattaccaagcttaagaaataaaacagttgagtgatctctcatttatgactaaattaacttattaaaaccattaaaacttttggattattcctgttaagatattttctttttttattattatgctttaagttctagggtacatgtgcacaatgtgcaggtttgttacatatgtatacatgcaccatgttggtgtgctgcacccattaactcgtcatttacattaggtatatatcctaatgctatccctcccccctccacccaccccatgacaggtcccggtgtgtgatgttccccactctgtgtccaagtgttctcattgttcaattcccacctatgagtgagaacatgcggtgtttggttttttgtccttgcaatagtttgctgagaaagatggtgtccagcttcatccatgtccctgcaaaggacatgaactcatccttttttatggctgcatagtattccatggtgtatatgtgccacattttcttaatccagtctatcattattggacatttgggttggttccaagtctttgctattgtgaatagtgcctcataaacatattttacgtgtcgctatgggatctctaagtc

SEQ ID NO: 727 - DNA, 6368 bp, Homo sapiens
ccatggacctgcgccctgagctgcccaccaccctgggccccgtcagcctgcgccagctggggctggagcacacccgctacccctgtctggaccttggtgccatgttgctctacaccctgaccttctggctcctgctgcgccagtttgtgaaagagaagctgctgaagtgggcagagtctccagctgcgctgacggaggtcaccgtggcagacacagagcctacgcggacgcagacgctgttgcagagcctgggggagctggtgaagggcgtgtacgccaagtactggatctatgtgtgtgctggcatgttcatcgtggtcagcttcgccggccgcctcgtggtctacaagattgtctacatgttcctcttcctgctctgcctcaccctcttccaggtctactacagcctgtggcggaagctgctcaaggccttctggtggctcgtggtggcctacaccatgctggtcctcatcgccgtctacaccttccagttccaggacttccctgcctactggcgcaacctcactggcttcaccgacgagcagctgggggacctgggcctggagcagttcagcgtatccgagctcttctccagcatcctggtgcccggcttcttcctcctggcctgcatcctgcagctgcactacttccacaggcccttcatgcagctcaccgacatggagcacgtgtccctgcctggcacgcgcctcccgcgctgggctcacaggcaggatgcagtgagtgggaccccactgctgcgggaggagcagcaggagcatcagcagcagcagcaggaggaggaggaggaggaggactccagggacgaggggctgggcgtggccactccccaccaggccacgcaggtgcctgaaggggcagccaagtggggcctggtggctgagcgcctgctggagctggcagccggcttctcggacgtcctctcacgcgtgcaggtgttcctgcggcggctgctggagcttcacgttttcaagctggtggccctgtacaccgtctgggtggccctgaaggaggtgtcggtgatgaacctgctgctggtggtgctgtgggccttcgccctgccctacccacgcttccggcccatggcctcctgcctgtccaccgtgtggacctgcgtcatcatcgtgtgtaagatgctgtaccagctcaaggttgtcaacccccaggagtattccagcaactgcaccgagcccttccccaacagcaccaacttgctgcccacggagatcagccagtccctgctgtaccgggggcccgtggaccctgccaactggtttggggtgcggaaagggttccccaacctgggctacatccagaaccacctgcaagtgctgctgctgctggtattcgaggccatcgtgtaccggcgccaggagcactaccgccggcagcaccagctggccccgctgcctgcccaggccgtgtttgccagcggcacccgccagcagctggaccaggatctgctcggctgcctcaagtacttcatcaacttcttcttctacaaattcgggctggagatctgcttcctgatggccgtgaacgtgatcgggcagcgcatgaactttctggtgaccctgcacggttgctggctggtggccatcctcacccgcaggcaccgccaggccattgcccgcctctggcccaactactgcctcttcctggcgctgttcctgctgtaccagtacctgctgtgcctggggatgcccccggccctgtgcattgattatccctggcgctggagccgggccgtccccatgaactccgcactcatcaagtggctgtacctgcctgatttcttccgggcccccaactccaccaacctcatcagcgactttctcctgctgctgtgcgcctcccagcagtggcaggtgttctcagctgagcgcacagaggagtggcagcgcatggctggcgtcaacaccgaccgcctggagccgctgcggggggagcccaaccccgtgcccaactttatccactgcaggtcctaccttgacatgctgaaggtggccgtcttccgatacctgttctggctggtgctggtggtggtgtttgtcacgggggccacccgcatcagcatcttcgggctgggctacctgctggcctgcttctacctgctgctcttcggcacggccctgctgcagagggacacacgggcccgcctcgtgctgtgggactgcctcattctgtacaacgtcaccgtcatcatctccaagaacatgctgtcgctcctggcctgcgtcttcgtggagcagatgcagaccggcttctgctgggtcatccagctcttcagccttgtatgcaccgtcaagggctactatgaccccaaggagatgatggacagagaccaggactgcctgctgcctgtggaggaggctggcatcatctgggacagcgtctgcttcttcttcctgctgctgcagcgccgcgtcttccttagccattactacctgcacgtcagggccgacctccaggccaccgccctgctagcctccaggggcttcgccctctacaacgctgccaacctcaagagcattgacttccaccgcaggatagaggagaagtccctggcccagctgaaaagacagatggagcgtatccgtgccaagcaggagaagcacaggcagggccgggtggaccgcagtcgcccccaggacaccctgggccccaaggaccccggcctggagccagggcccgacagtccagggggctcctccccgccacggaggcagtggtggcggccctggctggaccacgccacagtcatccactccggggactacttcctgtttgagtccgacagtgaggaagaggaggaggctgttcctgaagacccgaggccgtcggcacagagtgccttccagctggcgtaccaggcatgggtgaccaacgcccaggcggtgctgaggcggcggcagcaggagcaggagcaggcaaggcaggaacaggcaggacagctacccacaggaggtggtcccagccaggaggtggagccagcagagggccccgaggaggcagcggcaggccggagccatgtggtgcagagggtgctgagcacggcgcagttcctgtggatgctggggcaggcgctagtggatgagctgacacgctggctgcaggagttcacccggcaccacggcaccatgagcgacgtgctgcgggcagagcgctacctcctcacacaggagctcctgcagggcggcgaagtgcacaggggcgtgctggatcagctgtacacaagccaggccgaggccacgctgccaggccccaccgaggcccccaatgccccaagcaccgtgtccagtgggctgggcgcggaggagccactcagcagcatgacagacgacatgggcagccccctgagcaccggctaccacacgcgcagtggcagtgaggaggcagtcaccgaccccggggagcgtgaggctggtgcctctctgtaccagggactgatgcggacggccagcgagctgctcctggacaggcgcctgcgcatcccagagctggaggaggcagagctgtttgcggaggggcagggccgggcgctgcggctgctgcgggccgtgtaccagtgtgtggccgcccactcggagctgctctgctacttcatcatcatcctcaaccacatggtcacggcctccgccggctccctggtgctgcccgtgctcgtcttcctgtgggccatgctgtcgatcccgaggcccagcaagcgcttctggatgacggccatcgtcttcaccgagatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctgtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcgaagctgaggacagggaggaagaagagggggaggaagagaaagaggcccccacggggagagagaagaggccaagccgctctggaggaagagtaagggcggccgggcggcggctgcagggcttctgcctgtccctggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttgggaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgagccgctgttcaccatgagcgcccagcagccgtccatcatccccttcacggcccaggcctatgaggagctgtcccggcagtttgacccccagccgctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagagggacctggcgaagggaggcactgtggagtatgccaacgagaagcacatgctggccctggcccccaacagcactgcacggcggcagctggccagcctgctcgagggcacctcggaccagtctgtggtcatccccaatctcttccccaagtacatccgtgcccccaacgggcccgaagccaaccctgtgaagcagctgcagcccaatgaggaggccgactacctcggcgtgcgtatccagctgcggagggagcagggtgcgggggccaccggcttcctcgaatggtgggtcatcgagctgcaggagtgccggaccgactgcaacctgctgcccatggtcattttcagtgacaaggtcagcccaccgagcctcggcttcctggctggctacggcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatgg

SEQ ID NO: 728 - DNA, 563 bp, Homo sapiens
agcatatgtattcacaatattcattcagacatcattcccagacagcaggggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaaaaaaaaaaa

SEQ ID NO: 729 - DNA, 1984 bp, Homo sapiens
gtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcggagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacggagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcaaaaaaaaaaaaaaaaaaa

SEQ ID NO: 730 - DNA, 2447 bp, Homo sapiens
gcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgtggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 731 - DNA, 3319 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggagcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccagccaccagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaagg

SEQ ID NO: 732 - DNA, 3119 bp, Homo sapiens
cgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 733 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 734 - DNA, 528 bp, Homo sapiens
tttttttttttttttttactttttccaatggtcttttattttcaaaggctccactaaaattactttttttagatttctgggctatgggtttttagttgtgaattcaaagataaaagtcaagtagagcactgcatgagaataattcattttacagggcaatcaatcagaatttgcacatttgttatatccgagatgtacagttaggactcaccccttcttccactcacatactctgatttgcacagggctaagtgttacaaagacatggaaaatcttgaactttgttctttcttgggttcagaatctagaaaatggataaacaatgataagagatgacaggtcccttagagaaagttcactataaggcacaaaggggcttggcaaggtaattccaaatcagcagcagggttagaaatgaggagagcctccatatacagcctggtggttggtacccaaaaccggtttacatattttcaccatagagaaaaaaacagcagaatgtatcacatagaagacagagacatttgc

SEQ ID NO: 735 - DNA, 597 bp, Homo sapiens
ttttggatttcattaaatgattttaatagaaaagtacaagacatgaacaaaaataaataatctttatctcatttctagcccagcaaattgtacactgcatataaaaatggtctaagatgcaattttcctccattccttttttgcttttaaaatactgagacagcattttaattcaatattctaggttcaaactgatacattaaaaaaaaatcataccaacctttaatcattctacatccattttttaaagttagctaacaagatgaaggtttcactaaaataaaatatccaatcatcagattaaagtgtaaagtttgtgtgaacagggaaattagatcatttctctaagttttaattcctatgtttctgaatgtttcttgaattaaaaattcatttcatcatcttactttcaaaacacggcatctctctttcaccattccacagagagagaaaagactagaaaatactttaaaaaaaataaatattttaaaagtatagcttacagtgacaatgtagtattttagacctgtgccttcgtgcctatttgcattaaatacatgcttcagttataactaccttttctatctctctatatat

SEQ ID NO: 736 - DNA, 2415 bp, Homo sapiens
gcagsagtagaaggaaactttcttcctgcagcaacaaggaaatgacgcaaagtgagaagagccaggcttagtatcgtatgactccacttggaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcaggccgcgatctcggctcactgcaaccaccatctcccaggagaggcgggaagatttttgagcagcacctgaagagcctgaagctgacccagtccagcaccttttactcccaacgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccarggctttcagctttgggaaagcagtgggttcctgccagaggagtgggggcagctgctgtgccagacactgcaaaacacacctggcttctctccgacagccctgcggggtcgagaggactggcgctgcctgtgtcttactgaaaatttattttcgtgtaaccatttacttttatgtggaaatcgaaaagctttttataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggkgggctggatgctggagcacacgaggccgtgatgaaggtctccataaccccctcggacaaaacgccgccctgggctttggtcagattgctccccaaagaccagcacctcttcacccaaggagcagctttgagcggaggttcattgccctgggaggacgggcctcgggaacacttttccctcaacgaggtcacttcctggggcacaggacgacctgaggaaggtcacccccatcgcctactccatggtgaagcaggttgggatggcacctggcatcgggcccatctccttccctgaggcgcaggagggcctcatgggcatcgggcggcgccccttcaaccaaggcctgcagcagatgatggaccatgaagcaagactgctggtggcccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccaggaggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccacacagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatctaaaaaaaaa

SEQ ID NO: 737 - DNA, 3052 bp, Homo sapiens
gcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgcctttttttttcttttgaaacagagtcttgctctgtcacccaggctggagtgcagtggcacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacgtttgccttccttttgacttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatcattattttgttttttgtgaaagcagggctgggtagtacaatataatgatgaaaacagtgagggtagtacaatatattcatttgtctgtgaatgcttcttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacatttgctattcagcaacaacattttccccggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaataattttttctatagattggtgaaattggtttgtaatttttgtcatttcacttttgtggaaattgagcaaaggtgagagataaaatgatgtgatcaggctgggtgcgttggctcatgcctgtaatcccagcattttgggaggccaaggtgggcgcctgaggtctggagttcaagaccagcctggtcaacatggtgaagccctgtttctactaggaatacaaaaattggctgggcatggtggcacatgcctgtaatcctagctacttgggaggctgaagcaggagagtcgcttgaacttgggaggtggaggttgcagtgagacgagattgcgccattgcactccaggctgggcgacagagtgagactccatctcagaaaaaaaaaaaaaaaaagg

SEQ ID NO: 738 - DNA, 3640 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 739 - DNA, 2344 bp, Homo sapiens
cgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaaaaa

SEQ ID NO: 740 - DNA, 5449 bp, Homo sapiens
gcgccgggggccgccgcgcccgccgcccgctgcctgcgccgccggccgggcatgagttagtcgcagacatggacaccaaacatttcctgccgctcgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcacccccctgttttctctctgccttggtgttctggtttcagactcccgactccccgttcagaccagagtgccccggcccctccccagcctgagtcttctccttgctctgcggggtgggctgaggcttgtccttgtttcctgcagggctggccctggctcgggcagggtggggcatcaccacctcactggccttgctggaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggcctcaggtgccagggtttgatggacagtagcattagaattgtggaaaaggaacacgcaaagggagaagtgtgagaggagaaacaaaatatgagcgtttaaaatacatcgccattcagttcgttaaaaaaaaaaaaaaaaaaaaaaaaa

SEQ ID NO: 741 - DNA, 4804 bp, Homo sapiens
cagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaat

SEQ ID NO: 742 - DNA, 521 bp, Homo sapiens
ttttttttttttgagagggtctttctctgcccaggctggagtgcagtggtatgatgactgctcactgcagcctcaacctcccgggctcaagtgatcctcttgcctcagcctcccaggtagctgggaccacaggcatatgccacaatgcctgactagtttttatttatttttatttttttatagagacagagtctcaccatgttgctaaggctggttttgaactcctgggctcaggcaatcctcctgcctcagcctcccaaagtgctgagattacaggcataagccaccgcgcccagcctgaaatgttcattttaagtgtttattgtcctgtatgttttgaaatttttactgactatatgtaacaaatttgtcactccatctaggcacaagtgttttaggtgagcataaatttttttttttgagacagagtctcgctttgtcaccaggctggagtgcaatggtgcgatcttggctcactgtaacctctgcctcccagattcaagcaattctcttgccttagc

SEQ ID NO: 743 - DNA, 1901 bp, Homo sapiens
aaaaaaaaaaaaaaaaggggaaaaaaaaatgaataaagtgcttgggtagttctgatgagagagattatgtctaagaatacatcagggatggcttcatggaggaaaccatttttaatcttggccttaattaatagatacagagaaagaaagataaaaataaagaaaatagcttggcattccaggcagaatgaacaataaaggaaaacaatattgccttttgcaaaaatacactgtttttttttttgagggactctgtgttttcattgtttgtaatatcacgtctccgtgttaaagacctgtgtgtaattttcagtcattaattatgcacggatgatttctccctatgcagaatgctgtttgggcttaatcaggcaatcttttaaaagatgtagtctctagggatttgctatttaagaagtggaactagctacgttataattaaataattcctgctacagtaccatgtaaaaggtcattcatcattcaacatttatttattctacaaaatatttatcgagtgcccattatatatctggtactattctaggcaatagagatacacataagtcaatatttatccctcatggggcctaatattctttttttgttctttttttttattattatactttaagttctagggtacatgtgcataacatgcaggtttgttacatatgtatacatgtgccgtgttggtttgctgcacccgttaactcatcatttacattgggtatttctcctaatggtatccttcccccatccccccaccccacgacaggccccggtgtgtgatgttccctgccctgtgtccaagtgttctcattgttcaattcccacctatgagtgagaacacgcggtgttcagttttctgtccttgtgatagtttgctcagaatgatggtttccagcttcatccgtgtcactacaaaggacatgaactcatccttttttatggctgcatagtattccatggtatatatgtgctacgttttcttaatccagtctatcatcaatggacatttaggttggttccaagtctttgctattgtgaatagtgccacaataaacatacgtgtgcatgtgtctttatagtatcatgatttataatcctttgggtatatacccagtaatggggtggctgggtcaaatggtatttctagttctagatccctgaggaatcgccacactgtcttccacaatggttgaactagtttacagtcccaccaacagtgtaagtgttcctatttctccacatcctctccagcacctgttgtttcctgactttttaataattgccattctgactgatgtgagatggtatctcactgtggttttgatttgcatttctctgatggccagtgatgatgagcattttttcatgtgtctgttggctgcataaatgtcttcttttgagacgtgtctgttcatatcctttgcccacttttcgatggggttgtttgatttttttcttgtaaatttgtttaagttctttgtagattttggatattagccctttgtcagatgggtagattgcaaaaattttctcccattctgtaggttgcctgttcactctgatggtagtttcttttgctgtgcagaagctcttgagtttaattagatcccatttgtctattttggcttttgttgccattgctaatattcttaaattatatttaatatcaaacattctaagaaatcactctgtaatgaatgtaaaaccacctttgggtagagagtatgataccagtagttctatttaatcttccttttaaacaaatatatatttattttaaaacatgggtttttcatgattttttttttggttaaattttcagcaatgtgtttaatactccaggataccaaaaaaaaaaaaaaaaaaaaaaaaaaaaaaaaaaaaaaaaa

SEQ ID NO: 744 - DNA, 953 bp, Homo sapiens
atgagaaatttaagagcacggtccccaacgcagaatcaaaatcaactcaagaaagggaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaaatgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaacaggacaggaaagagcggacaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaagaaaaaggcagtgattcatttaaatctgagaagatggataaatctactccggtggcaaaaaggagtcaggcatgataaagaaagatagaaaggaagagaaagggacagttaaggaggaacggcagagaagaacataataagtctcggacacgaaagattaggaagattcactcaagggaaaccggacgagaaaggatcggaaggaaccagacaataataaccagaagaacatgccgaaataagaatgaaagggccaaggaagacccacaatatacatacacgggtaatggcacagaggaaaataaagagcaaatgagacaaagaaaacacagcaggcaaagacgtatatagaa

SEQ ID NO: 745 - DNA, 383 bp, Homo sapiens
tgcctctgctaggccagtatatttctgtacaaacaagataatgcaagatttgacagttaaggctttgaagcacagcacacaaaatgaaacaatttaaaaccccttcataaaaatgggaaaaattcccaggccaaaggaaaaaaaaagccttcacagaaagagactgacactcgactccccccctgctgaggtgtggccagtgagtctgggtgtgagctgccacctgacagccagctctgaggtatcaaaggagctccgagtgcaagttgaagacttcagcaagccagcccccggcccccacacccgttcataggcagtcggaatgcagatctcggtggcaggtggctctgcacagtccagagtgataaaacaatcacagatga

SEQ ID NO: 746 - DNA, 3389 bp, Homo sapiens
cctgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgatcctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagtcctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgggcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtgttaaacactcatatgcttatggcttggggaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaaaaaaaaaaaaaaaaaaa

SEQ ID NO: 747 - DNA, 4749 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagaa

SEQ ID NO: 748 - DNA, 3686 bp, Homo sapiens
aggacagtacagtgccttacttgcaagatgtgcaagcacacaagacctatgaagaactgtctcccaacaaaggatacatgcagaaggagaaaaaactctcttaaacaaaaagaggcagagccggcagggaccgagcgggtgcctcagtctccttcccctcccctcgcctgtcctcgccatcttcttctcacagccggaccggaactatgtgatcccggaagttccgggtcctttggccctatatgatcccggaagttccggggcttttggacctctgtgattccggaagttccggggcgttccggggcgttctggggcctttggagcgtgggataagcagtaatggcggaggctgcagctcccggaacaacagtcacaacatcgggagcaggagcagcagcggcggaggcggcggagacggcggaagcagtctccccgactccgatccccacagtcaccgccccgtccccgagggcgggcggaggggtcggcggcagcgacggcagcgacggtagtggcggcaggggcgacagtggcgcgtatgacggcagcggtgcgtgcggcggcagcgacgcgtgcgatggcagcggcgacagcagcggcgacagctggactaaacaggtcacttgtagatattttaagtatgggatttgtaaggaaggagataactgtcgctactcgcatgacctctctgaccgtctgtgtggtgtagtgtgcaagtattttcagcgagggtgctgtgtttatggagaccgctgcagatgtgaacatagcaagccattgaaacaggaagaagcaactgctacagagctaactacaaagtcatcccttgctgcttcctcaagtctctcatcaatagttggaccacttgttgaaatgaatacaaacgaagctgagtcaagaaattcaaattttgcaactgtagtagcaggttcagaggactgggcgaatgccattgagtttgttcctgggcaaccctactgtggccgtactgtgccttcctgcactgaagcacccctgcagggctcagtgaccaaggaagaatcagaggaagagcaaaccgccgtggaaacaaagaagcagctgtgcccctatgctgcagtgggacagtgccgatatggggagaactgtgtgtatctccacggagatttatgtgacatgtgtgggctgcaggtcctgcatccgatggatgctgcccagagatcacagcatatacaagcgtgcattgaagcccatgagaaagacatggagttctcatttgctgtgcagcgcagcaaggacaaggtgtgtgggatctgcatggaggtggtctatgagaaagccaaccccaacgagcaccgcttcgggatcctctccaactgcaaccacaccttctgtctcaagtgcattcgcaagtggaggagtgctaaggaatttgagagcaggatcgtcaagtcctgcccacaatgccgaatcacatctaactttgtcattccaagtgagtactgggtggaggagaaagaagagaagcagaaactcattcagaaatacaaggaggcaatgagcaacaaggcatgcaagtattttgatgaaggacgtgggagctgcccatttggagagaactgtttttacaagcatatgtaccctgatggccgcagagaggagccacagagacagcaagtgggaacatcaagcagaaacccaggccaacaaaggaaccacttctgggaattctttgaggaaggagcgaacagcaacccctttgacgatgaagaagaggctgtcacctttgagctgggtgagatgttgcttatgctttaggctgcaggtggggacgacaaactgacagactctgaaaatgagtgggacttgttttgtgatgaagaattttatgtcttagatctatagaaaccttgcgtagtgtgtgagctggtctgctgaccccagatagcagctgtcccctgtggtggtgtggcagtgcctatgttctctcctaggcagacctatcaactccaggtgctgcggttaagaatatgtacccagggcctgtcttgtcaacccctcacctttccccaaggagtgtgttgttttccctgttggaaaaagttacaaaaataaatgttaaaggttttttttgttttttgttttattgagacagagtcccactctgtcacccaggctggagtgcagtggtgcaatcttggctcactgcaacctccgtcttccgggttcaagccattctcctgtctcagcctcccaagttgctgggactacaggtgcatgctacaatgcccagctaatttttctcatttttagtagaaacggggtttcaccatattggtcaggctggtctcgaactcctgacctcaggtgatccacctgccactaccttccaaagtgctgggattacaggcgtcagccaccatgcccagccttaaagttagttttttgtaacaggcatgagccaccgcgcctggctttaaagttcgttttttgtaacaggcataagccactgtgcctggccttaaagttagtttttttgtaacacgaatttaactgttggacagttagtttagatgtgttgcatcatctgttttcaaccagattgtgtttatggacttttcacacactaattttgaggaccccaggttcaaaagtaaaagcagtggccctgctttggggtccaataataggagtgatgggtgaagggacctaagctggccagtagccttctgctccagacatgggacgcggatccttgaggtttctggttaaatctgcacatctgtgtttttatatctgttccctacccctgtaatccctaccgcatgcactagttctgtagttttggtctctcgtttaattgtatgcaagtagtactactgggtaaccagagccaagcgtgaatgtgttcagatttctactgttttgcatgataggaaaattgagaaagaatacatataaaagatatagaggcataacatcaatgcagagttggaagttgacctccacggggtgacatggtgtgtgtgagtgtgggtgtgtgagtgtgggtgtgtgataagcttctcaaacctgcatagatgcagtattcttggctttggtagaaagccttggtttaaggctgggcgcggtggctcacgcctgtaatcccagcactttgggaggctgaggcggccggatcacaaggccaggagatcgagaccatcctgtgaatggcgaaaccctgtctctactaaaaatacaaaaaattagccgggcgtagtggcgggcgcctgtagtcccagctactctggaggctgaggcgggagaatggtgtgaacctgggaggcggagcttgcaatgaactgagaatgtgccactggactcccagcctgggtgacagagcgagactctgtctcaaacaaaaaaaaacaaaaacggaaacccttggtttaggggtttaagtcttatgtggtggttaagatcttaaaggacaaagcagtatattggtagttatcaatatagcagtactagctctgtttatataaatagagaaatggagttagccatagaggttaaaactacctggttatcccatatattaacccaaactgggtcttggatacacagttgtatttaatgttttacgatctagcctttccagtataggcacttcctgaaaaacctttgtcctcatttggggcattttgttgttgggtttcgcc

SEQ ID NO: 749 - DNA, 544 bp, Homo sapiens
tttttttttttttttttttcatttctctctgaacagtttttaattttttattttttgatgtttgttgttcaaatgaatgacacactcaagttacaaaaatggggccttaaaagaagcacattgtacaatgaacaagcagattggagttaaaaacactgaaacactaacccgttaccacgaaaagagacggagggggtacaggaagggaaggaaggggctaccaacacaggggtcaaacggaactgaaaggggaggctaacttggtaaggatggaggaaaggcaggtctactccagggctgatttctggatgccggttcctgggcacccttgccttgtacttgccaccccctccaacttcacccacccccattccaacctggtcattctgggtggtgaaagacacccacaccaaaatgggctgcgccaatcaggtctttaccaagtagggtggtcaccttgccctagtgcagccctggatttggaaggtgatggtggaagcagtgggacaagaggccagaaaggagttgaaagttcaggcccctg

SEQ ID NO: 750 - DNA, 665 bp, Homo sapiens
  misc_feature 605: n = A,T,C or G
tttttttttttttataaccattggccctttaattgaagagtctaaaaactagaggtctgtaacagaatactaatcctgcagaacaagggacagaaaagtcaggcgaggcaagcttgtcttcgtaacctgggctctcaattggggtgctctcttacatttcaattgaatatctgtttttaaacctcccttcaacagtcagggtgtctgtctattttgtggcttccaaaattctaactgcaaaataaatgaccatcttatcatgttttcccatggctatcaggaggatatagcaattttatagattactacatggtcaagaatctacgcatcggatgtattcttttcttcttctttacttgatgcattcaaaagcaaccactggatttttttcaatgtaaaaaagaaaaatagatacccatgccaaaattcatgggtgtaaacagccaacagagccaaacttacaaagaaaatgaaagacttgtttctggacagtggttttattggtaaagatataagacatattggctctattaaaaactcaggtaataagcactaagcttgatttttgattgctacagtctctttcttctaagggaagaaatctncccaagaatggaagctacctgaggaatatgccgaataagaaaaggaaggatgggcggcag

SEQ ID NO: 751 - DNA, 584 bp, Homo sapiens
  misc_feature 543: n = A,T,C or G
ttttacagaactgttctatttattatacacacaagtatatcagttccctttgttaacaaaggctggttatagataatatggaatgttacagtaccatcttgcataaaattctagtacgattttgtacttgaaaaagggtgcaaaaacaccagactaataaatctgactgaattgaaatatctcttctttctttttaaaaagtacatcattaacacatacaccacaaactgtacataagctcactttaaatcaccaactggagatatggtagcatgtatactgtagtgttaattatccctcccatcagtttaatttattaaagccttacactgctgttcattcaggagcctttgttgatgtgcaagcctgtaatatgaattactgaactcaggtaagtagaatttaaaggaggccaacaacagctgccaagaattatttgcagtaagaaatgtccttctcacagaagactcaattaggagcaaacattttttagactatcttcctgctttcaaatatattgtagccggtcaagattctccattntgaactctggatgctggtggctgcatgaaatccttaaaagg

SEQ ID NO: 752 - DNA, 602 bp, Homo sapiens
  misc_feature 548, 565, 571, 582, 587, 591, 596: n = A,T,C or G
gtcgtcagtttggcctttcctactgcatccaggtgagagcttaagatgtcagtccccaatatcttcacagagtgcctttatgaccagtttggagaattacgatggtaaggggaagaggcagatatgaagaggaatggttaggggaattgtcattcataactctgtgctatattacttgaggggctaagaaaaatgtatggtcagtgaaacacagtagtgtacccttaaatgccttataaaagaccatccatccagtctgcgcttttgactgtgtgcaagtatcagtaataatgcttttgggggctcagatgaacagcgaacaccaatcagccaggactctggaaggaaagctccaaaaatgagaagtccttcaacaccattttccattactgttctcaccaaatcaatgactataaaacagttttgattatttatctccatcaaagtgatttgatttgagataatcacacaatctcaggctcggtatgtaaaaatgtcagaagtggctgaagtaaaagccgcacttttgtgctgaaacaccatttctntgactcagactcacctntggctnagattttcctntgggnaacnctgtnaaagga

SEQ ID NO: 753 - DNA, 1002 bp, Homo sapiens
agtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggwgcctcgtccagggagagctggtgacggcctccaaggccatcattgaaaaggagtaccagccccacgtcattgtgagcaccacgggccccaaccccttcaccacactcacagaccgtgagctggaggagtaccgcaggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagtbccccaakccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgacctggctctgcarcgtccccggccacgtctgtgctctgtccttgtgtawtggatgcaaaaarcaagcctcgcctagaggtccctcacgtgacagcccgtgtggccsggstgaccartgtktstcacabtccaccamctgcccttgtctytcgagctcactttgggg

SEQ ID NO: 754 - DNA, 510 bp, Homo sapiens
  misc_feature 457: n = A,T,C or G
ttccagtggaaacacggtattcatttctgaggactgtgctaggttttaaggcaattgtcacatgtacaaaacagtcagatgagcagtatctgaacagatttaccacaacatgttagaaagagaacagcaggggaaatgttttcagacaaggagatcgtgagattttccccagtcacgtaacccctggtctaccgactctgtggactgaaaaccaggaagatagacagcacattctctcttctcgcctccaaggggaagggccacctgcacactctcggaagcacccttctccagacccagacacgcttcttactgcagggccaggccaggacacaggatggtcggccaatgagtcttaagtccagctctaatttcacgctttatggctttgtgaaattcatctttagaaatgggaaaatcaagataccacagacatacaacttggagttaatagttnagttcccctctatccaacacaaactttgcttgggcttgggaggctaaaaccta

SEQ ID NO: 755 - DNA, 1865 bp, Homo sapiens
actggttttgcgagtggaggatgcagtctctttgtggttcctggtcctgtttgagaacctggggtcttgaggtggcctgtctgtgcctctcctttgtttcggcctgggctgggtggtgcttgtgagcatttgctccaggatccgcagacgtttcggtggtgacacctgccacgcacacgtgccgcactggggaccaggaacagggatgagtcaggcacagtccttgccttctgggagctcatggtccagaattgaggattcactcaacagatgtcccttgagcgcagaggatctggcagccccttctcagggggccggggcccaccgatgttgcatgctgagggtattttactttaacacccatggtgtgtctaggagactgaggtttccctggtttcatacttgctatctttcctcacgctgtgcctgtccccagcctggaaggataggtcagaaatccttcaaggtagctgtttcaggagatctttttctggccccaggtcaagttctctttggttccgtcctgagctcattacctcctggtgaatcatcacaccatatttattggacacctacagcttgctaagcattatatagaggcctgtctttgaggaaaggaaattaaacaagccctgtacagatcccccaagatgagaagtagctttagttgaggccactgctgctcttagcttctctggcccatctatgcttctagatggaacgtgtgtttaagatgcagattacaggtgtgagccaccacacccagcccaggctcattcttttaacagccttagcgcaactactaatgccaccaagagcggacaggaaggcctgggtcccatccccttgcgaagccagtaggtgaaacatggcagcttggcctggttccacttgcatcgccttttggtcctcacagtaatcctcagagtggcccaggtgggtagttggttggttggtttttttttttcagacggtgtctcgctctctcgcccaggctggagtgcagtggtgcgacctcggctcactgcaacctctgtctcctgggtttaagtgattcttcttctgcctcagcctcccaagtagctgggactacagtcatgtgccaccacgcccggctaattttttgtatttttagtagagacgggtttcaccatattgaccaggctggtctcgaactcctgacctcatgatctgcccgcctcagcctcccaaagtgctgggattacaggcgtgagccaccgcggcccaacagcgggaagtattttttccattgagtagatgagcagaatgagactcaaggggttgctcagatgggccgggcatggtggctcacgcctgtaacctcagcactgtgggaggccaagggggcagatcacttcaggtcgggagttccagaccagcctgttcaacatggcgaaaccccattctaccaaaactacaaaaattagccgggctcacgcctgaaatcccagcactttgggagactgaggaggggtcacctgaggtcaggatgtcaagatcagactggccaacagaatgaaaccctgtctctacaaaaatacaaaaattaggccgggtgccgtggctcatgcctgtaatcccagcactttgggaggccgaggcgggcagatcacaaggtcaggtgatcgagaccatcctggctaacttggtgaaaccctgtctctactaaaaaaaaaatacagaaagttagccgggcgtggcacctgtagtcccagctactctggaggctgaagcaggagaatggcatgaacccgggtggcggcgcttgcagtgagctgagctcccaccactgcactccagcctgggcgacacagcgagatttcccatctaaaaaaaaaaaaaaa

SEQ ID NO: 756 - DNA, 554 bp, Homo sapiens
tatgcatgtatacacactttattaaatttgcattctaagatatacacaaggccagcatttcacaaaacttcctattattccaaaagcagtaatcatgaaacagtgattatataagtcaatcaagcaaaaaacattatctatagggttgtatcatatcatctcttatacctgttttcaaatagaagcctgaaatatatgatatatattagaataggaagagagaattttactttataacaatcgcttttcaaatattagactttatataaaaataaaggggtcttaacaaagttcatctgtgagttagcatatctctttatttcaaaacaatccctgcaaaaacttaactttccagtccatttaaacaacaaaaactaaaaatgaagctgggttaaataataagggaatcatcttgctcctagttctcacaccattggaacaacttccatttcctgacctaattctatcccaccattgaatttcaaaaattaatgtaaataccatcatatttcagttatttcttaacagtgttaagttcgagcctaaaaatgatg

SEQ ID NO: 757 - DNA, 5766 bp, Homo sapiens
cgccgccgcagccgccgccaccaacgccaacaacaacgtgtcgggagcagccgcggccgaagccggagcaggggccggagtcgcggctggagtggggcctgcgcgtgtgagtggccgagagttgcccgtgccggagacctcaaactccgggcgggagcgctttcggtgggccgagccgccgtcgcccgcggcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctgccgccacctctcctgcaaggaagggactgacgcgttcccactttcttactctgcacctccccactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagataaaggtccctctccaccctctactaacactctgcacccaaggccttatcctttggggtcaccagctccttggccatttctatgtgatttcccccacccatctgagttccagtttcctctgggctccaatctccagtccctggcggatctggtcagtcccacccctaggtgggagtgaccagggggctctggcccaggattcccaaccctggaaggcagctccaaggcaggaagagaattgggcatcgggtacgaacctggcagctcaggagtcggggctccactcaccccacacaaaaagatgaaaaagcgcaaagagctcaatgcattgattggtttggctggggacagccggagaaagaagcccaagaaaggcccaagcagtcaccgcctgcttcgcactgagcctcccgactcagactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattactgcagagtgatatgaatcagcacttcttgaaggagactcctggaagcaaccagatcattccgtcaccttcagccacatcagaacttgacaataaaacccacagtgagaatttgaaacaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatgatgggtgatagatctgccactctgaaaagacagtctttggatcaagtcaccaacagaacagatacagtaaaaatccaaagcataaagaaagaagatagttcaaattctcaggtatccaagctaagagagaaactccagctgatcagtgctcttacaaacaaacctgagagcaacaggcctccagagaccgccgatgaagagcaagtagagagtttcacatcaaagccatcagcattgccaaaattttcacagtttcttggagacccagttgagaaagctgcccaactaagacctatctccctaccaggagtttctagcactgaagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggcatccctcaaaggcccaggcgctgccagggggtttgtcctggtagctggaggaaccgatttcagggaatagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgtttttttttttctttatatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactgagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctc

SEQ ID NO: 758 - DNA, 1526 bp, Homo sapiens
tgttaggacagtggtttaaaatatataagagaatcagtattttcttttcttttttttttttttttaagtatatattgatcattcttgggtgtttctcgcagagggggatttggcagggtcacaggacaatagtggagggaaggtcagcaaataaacaagtgaacagaggtctctggttttcctaggcagaggaccctgtggccttccgcagtgtttgtgtccctgggtacttgagattagggagtggtgatgactcttaatgagcatgctgccttcaagcatctgtttaacaaagcacatcttgcaccacccttaatccatttaaccctgagtggacacagtacatgtttcagagagcacggggttgggggtaaggttatagattaacagcatcccaaggcagaagaatttttcttagtacagaacaaagtggagtctcctgtgtctacttctttctacacagacacagcaacaatctgatttctctatcttttccccacatttcccccttttctattcgacaaaaccgccatcgtcatcatgacccgttctcagtgagctgttgggtacacctcccagacggggcggctgccgggcggaggggctcctcacttctcagactgggcagctgccgggcggaggggctcctcacttctcagacggggcggccgggcagagacgctcctcacctcccagacggggtcgcggccgggcagaggcgctcctcacatcccagatggggcggcggggcagaggcgctccccacatctcagacgatgggcggctgggcagagacgctcctcacttcctagacgggatggcggccgggaagaggcgctcctcacttcccagactgggcagctgggcagaggggctcctcacatcccagacgatgggcggccaggcagagacgctcctcacttcccagaaggggtggcggccgggcagaggctgcaatctcggcactttgggaggccaaggcaggcggctgggaggtggaggttgtagcgagccgagatcacgccactgcactccagcctgggcaacattgagcattgagtgaacgagactccctctgcaatcccggcacctcgggaggccgaggctggcagatcactcgcggttaggagctggagaccagcccggccaacacagcgaaaccccgtctccaccaaaaaaatagaaaaaccagtcaggcgtggcggcgcgcgcctgcaatcccaggcacttggcaggctgaggcaggagaatcaggcagggaggttgcagtgagccgagatggcgggagtacagtccagcttcggcttggcatcagagggagactagggaaaggggagaggggagaggttagtattttcaaaaatcatcatatagtacgtggttacacaactctgaatatactaaaacacattgaattgtatactttaaaggagtgaactatatctcaatatataaggggtgagttatagctcaataaagctgttaacaacaaaacaaaaatgccataccaaaaaaaaaaaaaaaaa

SEQ ID NO: 759 - DNA, 2241 bp, Homo sapiens
agtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggataaactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaaaaaaaaa

SEQ ID NO: 760 - DNA, 5239 bp, Homo sapiens
agccatgcccacgaactttacggtggtgcccgtggaggctcacgccgacggcggcggggacgagactgccgagcggacggaggctccgggcacccccgagggccccgagcccgagcgccccagcccgggagatggaaatccaagagaaaacagcccattcctcaacaatgtcgaggtggaacaagagagcttctttgaagggaagaacatggcacttttcgaggaggagatggacagtaaccccatggtgtcctcgctgctcaacaagctggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccggtctgcctcctggggaaccgcacgctgtcacggcgcagcttcgatgcctgcgtcaaggcctacggcatccacaacaactcagccacctccgcgctctggggcctcttctgcaacggctcccagcccagcgccgcctgtgacgagtacttcatccagaacaacgtcaccgaaatccagggcatcccgggcgcggccagtggtgtcttcctggagaacctgtggagtacgtacgcgcacgcgggggcgtttgtggagaagaaaggtgtgccctcggtgcccgtggcagaggagagccgtgccagcacactgccctacgtgctcaccgacatcgcggcctccttcaccctgctggttggcatctacttcccttccgtgaccggtatcatggcgggttcaaaccggtccggggacctcaaggatgcacagaagtccatccccacggggaccatcctggccatagtgacgacgtctttcatctatctctcctgcattgtgctgtttggggcctgcattgaaggcgtggtcttacgagataagttcggggaggccctgcaggggaacctggtcatcggcatgctggcctggccctccccctgggtcatcgtcatcggctccttcttctccacctgcggtgccggcctgcagaccctcacgggggcaccgcgcctactgcaggccattgcccgtgacggcatcgtccccttcctgcaggtgtttggccacgggaaggccaacggggagcccacgtgggcgctgctgctgacagtcctcatctgcgagactggcatcctcatcgcctctctggacagcgtggccccgatcctctccatgttcttcctcatgtgctacctgttcgtgaacctggcctgcgccgtgcagaccctgctacgtacccccaactggcgtccacgcttcaagttctaccactggaccctgtcctttctgggtatgagcctgtgcctggcgctgatgttcatctgctcctggtactacgcgctgtccgccatgctcatcgctggctgcatctacaagtacatcgagtaccgcggggccgagaaggagtggggcgatggcatccgtggcctatccctgaacgccgcccgctacgccctgctgcgcgtggagcacggtcccccccacaccaagaactggaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtgtggaggaagtgccggatgcgtatcttcaccgtggcccaggtggacgacaacagcatccagatgaagaaggacctgcagatgttcttgtatcacttgcgcatcagcgccgaggtggaggtggtggagatggttgaaaacgacatatctgctttcacctacgagaggacactaatgatggagcagaggtcgcagatgctgaagcagatgcagctgtccaagaacgagcaggagcgagaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatccggtttcaaagacctcttcagcatgaagccggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactacatggagtttcttgaagtcctgaccgaggggctgaacagagtcctcctggtcaggggtggcggccgggaggtgatcaccatctactcctaatgcccaacagcatcacggcactctgggacaggcacggaggacggcgtgggcagcctgggcctgggcttggcccagggaaccagacggcagacacacctgtcccccagtgatgccacccaagctgcccatggggcttcctacggaagtttctaggcccgtcacctagggctctcctgttcagccttaacaggctcagcaaatcagggcgtggctggacgatttccttgcatctgagggcagacgctgctaccggagtgacctggacgtggccagatcttctcgcaggtcacaagaagccagtgagcccttgccttggtttctggaagttcttttccttggctggatttacccagtggttaggttgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagtcacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggcaggccttgggctacgtctggcttgcatggtctcccaagggaatcaaccccatcaacaaagttcaaatcggggcagaggctgcacttgtgcccccagatgtttctgaggagccagattagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctgaaaaaaaaa

SEQ ID NO: 761 - DNA, 1062 bp, Homo sapiens
gcacgagcggcacgagtagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgtaaaaaaaaaaaaaaaaaaaaaaactcgagggggggccc

SEQ ID NO: 762 - DNA, 10300 bp, Homo sapiens
aactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccttcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagctttttttttttttttt

SEQ ID NO: 763 - DNA, 2008 bp, Homo sapiens
tgggacactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccacgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcggaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgcgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtaggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaaaaaaaaaaaaaaaaaaa

SEQ ID NO: 764 - DNA, 593 bp, Homo sapiens
  misc_feature 565: n = A,T,C or G
ggaataccattgtgtttattgatcaagcctggcttcgagtgtgacagagccattcttggttctccttggaagtaacaagaacactgggtaacatgtgaagtgcatggagactcacctgaatcccaccaaagtagtagctggacccagtagcctagcttattgtcttggcagtgcccctacccagtaccattagacctggctttgtcccttacataggacagactgggcttctccactcccgccaggctggccctacctccacctgtccttggaagctagtatgtaagtaagggaggagtcatcaagtttataagatgggtaggctgaggattgaggcaggaggggacttaatggctgagtccctggcttgttccagagccctggcccttgagcccctggactggtcagtgcatggacactctcccctcccagctcgggcggaagacttttcctgacttagctgctccatacacacaatctataaatatgtatttgctttaaaaattaaataaattagatcttgggccagcctgaggtcatctggccagccatggagtcctgtganatggacattgtcatgtgtcatatataga

SEQ ID NO: 765 - DNA, 496 bp, Homo sapiens
gacaattgtgaacgttgttgttccattctttctttctccaatttcttctgcttttcacgttccattttttcaagaccttcgcgaatccaagccgggaagagtcctgcgttttactgcgtcaatttgtggaggctcctgcttcacaggaagttcaataggtgaacgctgacgatccctgaatgatgatggcctttctcttcgattctggggaggtgctggaggtcctggaggtcctggttgccaataaggtggatgaaatccaccttgcggtggaccaaaagcagccccatgctgatagtcaaactggttcactgctcccactgcaaaattatcgggtggtccaccaaagttgtgattgttctggttaaatatatgcctgttgtcaggggcaaattctccactgtcctgactgttgctgtcttcagaaggaggaacaatgtccattgggacttgtgttggtggcatccatggctgatctggaggggggtgtgggggt

SEQ ID NO: 766 - DNA, 556 bp, Homo sapiens
tttttttttttttttttatgctctttttttggttctaaaactgatgtggtttcatttggagttctcttcttttcattaaccacatcaccgtctgcttctcttgcttctagtagtgataaactattttgctctttatggataaattcattcatctcttttgtaaccctttctgtttgctgcttttcttcttccatctgtttatcatgtaatagctgctgttctttttcttttctccaaaaagcttccctgtttttgccggattcgatgccgtaattcttcatcatcagtgtcagatgactcagatcctctgtcactcctctcatcttcactgtctcctgatccataaccacccagtccacctttcgttgctttgcggtgtgcatctttggctacgtaataaatttcttcatctgtgacatccagcagaatttctgttagaagcatttttgtcagcaacatcatttgatactctttctcctcttcagtcatctcagggtcactgtgctcttcttgaggaactggggatggacttctggtgactttcccactacttgca

SEQ ID NO: 767 - DNA, 206 bp, Homo sapiens
gggaaggggctgcagtgggtctcagctattagtgggagtgcaggtaccacatactacgcagactccgtgaagggccggttcaccacctccagagacaattccaagaacacgctgtatctgcaaatgcacaggctgagagccgaggacacggccgtatattactgtgcgaaatcccaccggcctaattactactactactacggtag

SEQ ID NO: 768 - DNA, 2027 bp, Homo sapiens
gatgtatatgtttgaagtgtgcgtgtagcattggggacaggcagaggctctgctcactggggaatgatgttctggtggaacaccccatggacttggagcttgagaagtgggctttggccaggccctggcactgaccacctaggaacagtcatcttttccaagcttctggttcctcttctgtaaggtgcgagtccctaaccacctttccaaagacagcatcctgtgcaagctgtcacgggagggggaagggccctggtgaccctcagggcctctagagcctgtgggcaagagctggccctccatgccaaggtgccaggcctaaccctggtgaagagtgacccaactgggcgactgcctgaggcctcagaggaggacaaggagaaggtgcacagcagcagggtgcacaccttgccctggcctctcctagggtagaggacggtgtgagcccccagaggctgtcatccagcctgagaggtttcttggctcttcctcccatgcccagggttctcccagactgcagagcaagatccaggctccacacaatgccagaggccctgcctctatcttctctctggccagcggccctatcgctaaccccacacatgaaggatactgctttggcatcatcgtttgtgagggccaggctggggaagggtggagagagtgtccttccctggggaggctgaacccagggagatggagtgacatgccccaaaaacacagcaagtgggactagaacccatgtctccagatggaaccccaggctcccactgctccatgctgtgcaggttacacctcccaccctgccgctctctccgggggcctcagtccacctcctgagcccatgtcctcagtccatgattggaccgggtccctgggtcccttggaggaccagccaagcccaggtccttctttgcttcttactccccaccccagtctccttgttcttcagtcttttgctttcccactggctcccttctcacacctcccatggctgtgcccatttctccttttaactctgtcaacttttggatcctatatttgaagcaaggcatgcatatatattttaaattttattatctctgttttgatctttttgtcataaaaaattcgtttttatttctaataatacttcctgccttaaagtctacatttcctgtttgaatgatgttcagtgtccattgtgtaaattctcatgtggtaatttcctttaagaaattattgaggggccaggcacagtggcgcatgcctgtggtcccagcactttgagaggctgtggtgggatagtttcttgagcccaggagttcgagaccagcctgggaagcatggcgaaaccctgtctctacaaaaaaaacacaaaaattagccaggggtgttggtgcatacctgtaatcccagttactcaggaggctgaggtgggaggatcacatgagcctgggaggttgaggctgcagtgagtcaagattgcaccactgcactccagcttgggtgacagagtgagaccctgtctcgaagaaaaagaaattattgagggcagggtggtggcacacgcctgtaatcccagcactttgggaggctgaggcaggaggattgcttgagctcaggaggttgaagctgcagtgagatgtgtttgcgccactgcactccagcttgggtgacggagcgagaccctgtctcaagaaaaaaaggagaagctactgaattgcagtaaaaccgtgtgcttctatgaggggataaagtatttacttgtggctgggcacggtggctcacgcctgtaatcccaacacttcgggaggccgaggcgggaggatcacctgaggtcaggagttcgagaccagcctcaacatggagaaaccccgtctctactaaaaatacaattagccaggcgtggtggtgcatgcctgtaatcccagctactcgggaggctgaggcaggagaattgcttgaacccaggaggcggaggttgcggtgagccaagatcgtgccattgcactccagcctgggcaacaagagcgaaactccatctc

SEQ ID NO: 769 - DNA, 2628 bp, Homo sapiens
tttatttttttttttttttttttttttttttttttatttaaattcttttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttaaatggtttgtattttggatgcttctgaagagaaacaaagacatatagaatttaaacattatctgtgtttatttgtaaaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattacaggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttttttttttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacctcgtgc

SEQ ID NO: 770 - DNA, 2418 bp, Homo sapiens
gtgcagaaagcaccgtcttttactagaagaagacaataaaatgttggtcaatgaactgaatcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaatttcaagaaatacaggatcaacttacagctactataagatgtactaaggagatggatggcgacacacaaaagcttgaagtagaacatgtgatgatgagaaaaattattaaaaaacaggatgaccaaattgagcggcttgagaaaatcctgcagcattcaagtttgatgctgcaggtgtttgagagctagatgaagatatggacatttctggaattaagagccccctctacattgagcacaagacagtgacgaatccacattcttcagccagaaagtcacctctgagagccaaatgtctgactatagaaaggagagtcaaagaatgataacgacatctcaggaaaattgtgaaaataatcagcagccggatgtggataaccctttcaaatttctcctggggcctccaaccacccccactggtgttctcctgctgacagtgatttcaattttttctgggctggagctccctgatggaggggcaggccaccatctttgctgtttttgcaacttagccacttcagccttcagtctttggagtgtccaaggagaccagggggtgatgtggaccctcagcatagcacagctgctctataaagatgaggccagactgcttttttgagcactttcccaatgccattcctcctcactgggcaaaacctccaaactggggtctccagccacctcctacaggtgtgtttgggccagcaacaagttcattcatacctccctagggcaaagcttccaaagggagcggtaggctgccatctttgctgtttcacaggcttcactgatgataactccaggtactggaaaatctgaggctactagagactggagcgggccctgggcatactgcagcagccctatggaaaagtggccagactgttacctgggttcccattcctatatcttctcactaggcaagtcttgcaggcctgggcctctacctaaccccccctaccagaactgttgagccagtagcaactcagccactccctggagagagcctccaggggcaactgaaagcctctctgccactgcttctgcagtggaactgtccttgctaccctcagactgatgaaggagctaacacccttatctacaccttcaacaagctttaattgaccaaagcccatctctcatgggttctacacactccccactgctcatgacagggaacccctggattggcccccacagcacgaattctccatcctgattgctgattgcagtaaacagttgctgtattctccaggggtggtggaactctgaggagacaaacaaaagacccttggctacaaccactactaatgtcccttcctcttctgcctcaaagttaggaaagaaatataaacactgagattgccccagagctgcagtgggcagcctaggagtgccaagccatgacctacagccagcactcaagggggagagaagcacattttcagatcattgagagggaacatggctgcaactgtaaggaaacataggggagccacatgaccaagcaagagtctaccaactgaccagtaagcccaagtgccacctactggatcacatcccaaagcttcagcatcaaaaataccctactaatatactcccctctgaaaccagaaatgagaagtcagcttcaaataaagaccctgcacaaagcctcagcctggtgaaaacatccgaaaataagtctacggactgtactcaatctacactgcaattaaaggaaaacccataggtggaaatgagaagaaaccaatgcaagaactccagtaactcaaatggcctctgtgtcatatgtccttctaacaaccacaccagttctccaacaagagttcttaacctggatgaactgtctggaattacataaatataattcagaatatggataggaaaaaaaatcatcaagactcaggagaatggcaaaacccaatccaaggaaaataagaataacagtaaagtgttacaggagctgaaggataaagtagctggtataataaaaaagaacctaaccgatctgaaagcgccgaagaacacaatacaagaattccacaatgcaatcacaagtattaacagcagaaaaaaaaacctgaggaacgaatctcagaacttgaagattggttctctaaaataagatggacaaaaaaaaaaaaaaaaaa

SEQ ID NO: 771 - DNA, 683 bp, Homo sapiens
ctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 772 - DNA, 3699 bp, Homo sapiens
gaaatcaaaactaaaaatccttgatgatgtgttatgggtgtggtttgtacaagagagctaatacagaattccattcagtgaatcctctgtttaaagagaaagccttggcctttgtcagaagatgggaaaacaaatgtacatttataaactttcagttaaaataaaatgtttaaattatatatctgtgtatcttttttttttaaacgattccttctaacctttttttttaaacgattccttctaacccatttttttttttgttaaacccaaccagccaactcttggtcctgattgtattggaaactagggcttctattaaagatagttaacatctatttagttcatatacaatatcagcattattcgaagagtttcacttgaattatctcagttaagcttcgtaacaaccctatgtcttctctttatagttaagaaaactgaaccttagagaggtgaagaattcgtccagggtcataaaactagcaagtggcaaaattgagatttaaacactgctaggtgttaccttaggatctaaacttttaaccattactccaaagtacaggctgggtgcggtggctcacgcctgtaatcgcagcactttgggaggccaagacgggtggatcacttgagcccaggagttcaagaccagactaggcaacatgacaaaaccccgtatatactaaaaacaaaaattagccgggcatggtagcacacacctgcaatcccagctccttgggaggctgaggcatgagaattgcttgaacctgggaggcagaggttgcagtcagccaagatcgcaccactccactacagcgtgggtgacagagtgagaattggtctcaaaaaataaataaataaactacataggaaataaaactacctggaatcttttcttttacaaaatcaatatgacacacatatcggtacttgacaaagacaacatgaaaaattttataagatattaggccgggaacggtggctcatgcctgtaatcccagcactttgggaggccgaggtgggagggtcacttgaggccaggagtctgaaaccatgcctggccaacatggtgaacgcccccatcccccatatctactaaaaatataaaaattaggctgggcatggtggctcatgcctgtaatcccagcactttgggaggctgaggcgggtggatcacttgaggtcaggagtttgagaccagcccggccagcatggcgaaaccctatctctactaaaaatacaaaaactaaccgggcgtggtggtaggcgcctgtagtcccagctcctcaggaggctgaaacacaataattgcttgaacccagaaggcggaggttgcagtgagccgagattgctctgccgcgctccagcctgggcgattgagactgtctcaaaaaaaaaaaaaaagaaaaattgtataagatattaatccaagaattctaagggaggtactagcaaatagtatccagctttttatcacaaagttaacctgcagaaaaatgatgggagctaagatgatacagagggtcaagaaaggtatctccctttaagtgacatttgagcagagatctgaatgaagaaatggcaaagtaataaagactctgaggcatatttggttttttttttttaggaatatgttctcagtgaaccatatggggggaaagcttggtttatccattttatagcatgctgtactgttactaagaaggaaatagttggtcaggcacaatggctcacgcctctagtcccaacactttgggaggccaaggcgggcggatcacttgaggtcgagttcaggaccagccttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgtcaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatatttcttccctcaccttatttacagtaatgctaggttgtttataggctcaggaatgatgagacctagtgtcagtatagtacagatacatgtaaaactgatcaagagtgataacactaatttgctttaaatggctttacaccatagtgaatgagttattttatttataatttgctttgttccagaaagtattttaggcagattacaaatattttataatagaagtagcatagattaaaaagtgatggagggaggccgggcacggtggctcatacctataatcccagcacttcgggaggccgaggcaggtagatcatctgaggtcagcagtttgagaccagcctggccaacatagtgaaaccccgtctctgctaaaatacaatacaagccgggcacagtggctcatgcctgtaatcctagcactttgggaggccgaggcggacaggtcatgaggtcatgaggtcaggagatcaagaccatccgggctaacacggtgaaaccccgtctctaccaaaactacaaaaaaaaaaaaaaaaaaaataaaaaaagccgggcatggcggcgggcacctgtagtcccagctactcaggaggctgaggcaggagaatggcatgaacccaggaggcagagcttgcagtcagccgagatggcgccactgcactccagcctgggcaagagagcgacactccatctcaaaaataaataaaaaaacaattagctgagtgtggtggcacacacctgtaatcccaggtacttgggagtctgaggcaggagaactgcttgaacctgggaggtggaggttgcagtaagcggagattgtgccactgcactccagcctgggcaacagcaagactccatccc

SEQ ID NO: 773 - DNA, 3140 bp, Homo sapiens
ctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtgcactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatgctggttctcagctgtttaaaaaaaaaaaaaaaaaaa

SEQ ID NO: 774 - DNA, 4099 bp, Homo sapiens
gggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgtt

SEQ ID NO: 775 - DNA, 858 bp, Homo sapiens
cacgcactggccccggcgcccacccgcacccctccccagagcactgacacggctcccgggacctcggcaggatggaagagaagctgaagaaaaccaatatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggaaaaaaaaaaaaaaaaaaaaaaaaaaaaaaaaaaaa

SEQ ID NO: 776 - DNA, 3036 bp, Homo sapiens
gacctccttccggaagacgctggtgggcgagcccttggaccctgagcaagacctgcaggaagcggatatcctcacctacaattacgtcaagaagtttgagagcatcaatgatgagaccgagctggaggccctgtgcgctgagatcgcctcccagcacctggccacggagagccctgacagccccaacaagccctgctgcaggttcacctacctgaccatgacgggcgaggaggtggagctgtgcagccggggccggcacatccttgtggcgtgggagaacaaggacatctacgcggcagccatccggagcctgcggctgcgggagctgcagaatgtggagtgcgtgacggccgtgcgggccggcctgggctccatcatccccctgcagctgctgaccatgctcagcccactggagatggagctgcgcacctgcggcctcccctacatcaacctcgagttcctcaaggcccacaccatgtaccaagtggggctgatggagacggaccagcacatcgagttcttctggggggccctggagatgttcacccaggaggagctgtgcaagttcatcaagtttgcctgcaaccaggagcgcatcccgttcacctgcccctgcaaagatgggggtcccgacactgcccatgtgcccccgtaccccatgaagatcgcccccccagatggcacagcaggttccccagactctcgctacatccgcgtggagacctgcatgttcatgatcaagcttccccagtactcctctctggaaatcatgctggagaaacttcgttgtgccattcactaccgtgaagaccccctcagtggctgatgggagggagccccagaattaggctgtcactgaggcacccactctgctggcttgggaagccaccactgcggcccgtccctccagggccctgcgtgaggacttggcaacattttgcttttccaaactttcgtccacattccagggcctcctggaagacttaaccttttgtctttgtacgtttcgtgatgggttggttcttttgctgcctgtttgtggtctatttgtaggatagtttagttcccagacagtttgtgtctaatttgatcttcttggacattgtccctcatggccaccagattctaatgccataaggccccagctggttccccatcacagaaccacccagcaggaagccgggggtacaatgacctcggccacacagagcgctcgtgctttcagcagagcgcctccacagacaagcctgtggccagccctgccctccagcctcgagctggagttgctccagaggcagccccagcaggcctccctccacatagaggtggctgggccaattgcccaaacacgtgagacacacagggagctttatgtgttcatcttcctgctttagaacttgctcccggtcttggtttttctgaggaaaagcccacagtggttcccctgcccctcccatacctccctatctgccgtctgtctctttgggccctggtctgacagttttcatctgaggcctcctcgggagcaggagacttaagggttcatcccgaccttagttcacagagcctagctgggtgcatcccagccgcagggggtgagaagacacccagagatgggggacaatgctcaggtgggggcctcctccgagactctggttgagaggaaagcacatgattcaagcctaccccacaaaaaaggagcacaaaatgctcagaaatggcccttcctccctgcagtgacgtaggacaagggaaagggccacacccattttcaaaagagtggactgaggtgctctgctcaatttggggtctgctttagtgacccagacactcaagtccagatggagactccaggggggtccttctgcccctctggccagccccacccagcactccccatcaccccatgtaagtgtgtatgccagggctgagctgcctccaggctcacccactgcatctttgccccaaataggtctttgtccagtggtactttgttcatgagcagcacaggccatcttgttggacactgtcactttgggccttgccaggtctcacagaatcacatcgctgtatttattgtataatattgtgaatattggaagttttgagtgagtgctgtctagaaggttttggagtgtggatgctggtccaagaaagaagatgtgccctggcctgctggaaagattgtgaattctagagatagagccgttagcatccatctcctccctgtaactcttaggaaatgcatcaaggaccattatagaaaggatcccctgacctaaggatgaaatcgacctagggttaatcatgacagctgcatcagttgtattggatgcaagtcaactctggaggtgagtgcccgcaagcagttcccctgctttgaaagaagatggtcagcccgctgcctccccagcggccacagctcctttgagtgtggggggtcacagccaggatgtattcctgacaataaggatccttttattttcatttctgcataatgaaagagcctttcgatttattagaagtggtttttcctccctacatctttaaattcttggttctctttagtcctcatcccttgaatggacttgtcagctacctccccaggaggagttcagaagcttctgttggccatcacttgagtagatgacaagctgtaaggtatctgctgctaacgtggctgcttctccgagagcacattgaggtccagacagatccaaaccttggccctaaaaaatgtgtgctgtaaagttacttgatgtatatttattataattatttatggttgcatttaacaaacttttcattcaatctgatgctatttacaccatgctgtgtaaaggaagctcactaaaggaaaaaagtcacaccaataaataaccttcatctaattttgatttaccttaagagttgtgtgatcatctactcttgctgagcaagttcaaaggctggcatgcttggatggctctgatatttaagtgctgccaagtggctaggaattaaagtgtttctaattaaaaaaaaaaaaaaaaaaaa

SEQ ID NO: 777 - DNA, 570 bp, Homo sapiens
  misc_feature 446, 490, 520: n = A,T,C or G
cgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagaccgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcaccccaacaaaagcaggggtataaggcgntattgggtgatgaaagtccttagggaaaatgcataatttttgcnataaatggtacctaatttggggatacccantttatatagagggtaagagacactgcttgggggatatgccttttatgggt

SEQ ID NO: 778 - DNA, 1669 bp, Homo sapiens
cggggtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctacgacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctctcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatccgcagcattaaacaagccagaaaagcc

SEQ ID NO: 779 - DNA, 4140 bp, Homo sapiens
agtgctgactccgtacacgcgcgctgcggcatggcggcccaccgccccggcccgctcaagcagcagaataaagctcataaaggcggacggcatcggggtcggggatctgcacagcgggacggcaagggccgtctggcactgaaaaccctaagcaagaaggtgagaaaagaactcagcagagtcgaccagaggcatcgcgccagccagctccgaaagcagaagaaggaggcggttctggcagagaagagacagctgggtggcaaggatggccctcctcatcaggtactggtggtgcccctgcacagcagaatttccctgccagaggccatgcagctgcttcaagatagggacactggaacagtacacttgaatgaattgggaaacacccagaactttatgctgctgtgcccccgcttgaaacatcggtggtttttcacctcagcaaggccaggggatctgcacgttgtgttagacatggctaaagtagctgataccatcctgttcctccttgatccactagaaggctgggacagcaccggtgattactgtctttcctgcctctttgctcagggccttccgacctatacactagctgtccaggggatttctggcctcccactgaagaaacaaatagataccaggaagaagctaagtaaagcagtggagaagcgctttccgcatgacaaactcctcttgttagacactcaacaggaggcagggatgctgcttaggcagttggctaaccagaagcaacagcatcttgcttttcgagatcggcgggcctacctatttgcccatgctgttgattttgttcctagtgaagagaataacttggtgggcaccttgaaaatttcaggctatgttcgagggcagactctgaatgtcaataggttgctgcatatcgttggatatggtgatttccagatgaaacagatagatgcccccggagaccctttccctttaaatcctagaggaattaaaccccaaaaggacccagacatggcaatggagatttgtgctacggatgctgtagatgatatggaagaaggtcttaaagtcctaatgaaggcagaccctggtagacaggaatccttgcaagcagaggttatcccagatccaatggagggagagcaaacctggcccactgaggaggagctgagcgaggcaaaggatttcttgaaggaaggttctaaggtggtaaagaaggtccccaaaggaacatccagttaccaagctgaatggattttggatggtggcagccaaagtggtggggaaggagatgaatatgaatatgatgatatggaacatgaggattttatggaggaggaatctcaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcgatttcagaaatacagaggccttaagagcttccggacatctccatgggatcctaaggaaaaccttcctcaagattatgctcgaatatttcagtttcagaactttactaacactaggaaaagcatctttaaagaggttgaagaaaaagaggttgaaggagctgaggttggctggtatgtcacacttcatgtctctgaagtccccgtctcagtggtcgagtgcttcaggcaaggaacacccttgattgcattttctttactacctcatgaacagaagatgtcagtattgaatatggtggtgaggcgtgaccctggcaacactgaacctgtgaaagccaaggaagagctcatatttcactgtggattcaggcgcttccgagcctcacctttattctctcagcacactgcagcggacaaacataaattgcagagattcctgactgctgacatggccctggtggcgacagtctatgcgccaatcacttttcctcctgcatctgtgctgcttttcaagcaaaaaagcaatggaatgcacagcctcattgctacaggccatcttatgtcagtagatccagacagaatggtcatcaagagagttgttctgagtggtcatcctttcaaaatttttactaggatggcagtagtacgttacatgttcttcaacagagaggatgtgctgtggtttaaaccagtggaactgagaacgaagtggggccggagaggacatatcaaggaacctttaggtacccatggccacatgaaatgcagctttgatgggaagctaaaatctcaagacacagtactgatgaacctgtataaacgagtcttccccaaatggacttatgatccatatgtaccagaaccagtaccctggctgaaaagtgagatttcttcaacagtgcctcaagggggcatggagtaatggattcaaagagattctgtcttaccggtgccagtcagtactccagggatgggaggcacaagttgtgattgggcaaagtttattttctatgtcagcctgtcagtccactgccccattttgcaagacttttttttagccttgacaaaatgtctcagttaagtataaaagtttttccactacttagtccaaaaaaaactattaaatcttaatgaaatagccactctccattaagaatctgataactaagagttggcaatactaggaaacaaaatgtcttcagtatctaaagacactgaattcccaccatttccttttctgtaaattaaacagaaacagactgataagaagctggcctttcagcctgcttcacccaagttatggaggaggttaagtctacatttccaccactgagcacaatacaaatgttctttacttctggggaaacagtttgaaaatgttgagacagcacagcagccactccaacaccagctgtaggttcaatgagtagtttcatcctctcccacaccagctgggttgcacactgttgatatggaagggagtaggaattagtgaaaggggagtctagttggtttacctataaagttcagatgagaatacgtgtccagtttgaattttcttatcactgtgtacacacgcttcccaaagcttttctttaattctgactctgcttctgtcaagagggttgtcattaatacatctagggtaccctcccatgtcatgaagttacctagtcaggttcccgtgggtcacttgctactcctaagggaagtttcttctgcctaagaagttgcaccatgctttgctatttcttttcttgctggagcctcaccttaatttcatcctctgtgacagtgaagatatcatccacaaggtccctgataataggccaggtgttcaagccaatgctggatttgacaccatctgctatggtttctggaggataaagattgggcatcagtttccccttcagcttggactggtagcagtcatctgcatttgagggttcagcagcatataccttcacactaggtttcagagcctgggaagaggaatattaagacatcttaacaacaaaccacaacattgcctgcaagtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgcagtgagctgagatcacaccaaaatggggtggggcgcagtggctcacgcctgtaatcccagcactttgggaggccgaggtgggcggatcacgaggtagggagatcaagaccatcctggctaacacggtgaaaccccgtctctactaaaaatacaaaaaaaaaaacaaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaaaaaaaaaa

SEQ ID NO: 780 - DNA, 3003 bp, Homo sapiens
caccgcccagcccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagcagaaaaaaaaaaaaaaaaaaaa

SEQ ID NO: 781 - DNA, 878 bp, Homo sapiens
ttcatttgaaacacaaattcagtaggacgtaatgcatgaaataatttaatttttgacatgtacatcgaatcataatttaaaaacaaggtctgaccaggtgtagtgcctcatgcctgtaattccagcacttgggaggccaaagtgggtggatcacctgaggtcaggagtttgagaccagcctggccaactatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaaagaaccagctggccaacatggtgaaagccccattctctactaaaaaatataaaaatcagcgggccatggtggcatgtgcctgtaatccccagctactcaaggagtctgaaggaggagaatcacttggaaccttggaggcaaaggttgcacgggaggtcgaggttgggccaaggatccaggcggggacaccggggggaccgcggctcaaagaaaaaaaaacctccagcggttcaaggcaccgacaagcacaggggcggtttcggcgtgaacccctaaaagggaccgggcggcgcaggagaaaacaca

SEQ ID NO: 782 - DNA, 117026 bp, Homo sapiens
gatccaggtacatgtacatggtattaggtttggccaaaaggatggacccctctcccagcagtggagagagaagggagcaggcgataggaggctcacgttagatggctcctggctttttggagaaacaggaattgaggatgctgattggagaagtatgggggctggggttggcagaagggaaacaagtttgggagggcagctgtgtggaagtggacagggtgcaggcctggggtggctggagatttgccttgtgatgtgcaggggtctggaaccacacatcggtgatgatgccagttggcagggtagagatttttgtttccttagtgaaagcagctggggcacaggtggagaggaagcaggtggcaaggtaactcaggagtggatgtgggcagagaggaggggtgggaggaaactggggtgaagggccaagggagctaaactggaggtggcctaagtgtctggaggagaggctggaacaggtgtgggcagcttggattgggttccctctgccccatgtcttggcagggctgcctgtggacctctctgtaaagccaacactaagggcctgggaacaaggtactcctaaaatcccagcgctgggaaacagactttgagagagggttacttccaagcctctgcctatatggcaaaatgactcctgagctaccctgaaggagtgcaaagcaaggacagagtcagcctgtccaccagcctagtaagatcccctccctctgattagggtgtgagtggcaaaagtgtatcaagtctctgtgaattcagaggaggcagtgtagacagctgaggaggtatacaagcttcagagtcaggcctggccccaagtcctggctttcttctttcttagtctgtcatcctgggtaagttaatctacctgagcctcagttttcccaccaataaaatggggataacaattcctgccttacaggctcgtgatggagtgcctggtatagtgcctggaacatagaaagcacttggtaaatggtagctatgagctctaatttgtgtctcggggtgtctatgtcttcttaaggtagagtaggaggtgcaagacagtagggatggagagactccagagctacctagtgggcaagtgaatattcttctaactgcataatgtataagtgctgatgacaagggcagtgtgctggaatgcatggaatttttggaaccttctcagtaggtatgtatgacagacaggaacctgttgggggtggtgagaatctagcccagttggctgtgctcacacccagtggcatcaaagcctaatctgggacaaggctgcttcttcccaccagccactactatacctttgttatcaaacccttgggcttttttatttttattttttttttgagctctgtcgcacaggtcagagcagtggcacaatctcggctcactgcaacctccaactcccaggttcaagtgattctcctgcctcagcctcccaagtgggtgggattacaggcgtgcaccaccacacctggctaatttttgtatttttagtagagacagggtttcaccatgttggtcaggctggtctcaaactcctgacctcaagtgatctgcccaccttggcctcccaaagtgcttggattacaggtgtgagccactgcagctggccccaaacacttgggcttttgttcttctgagaagtagtggaaagaacaacaatagcctctacctattaaatgcctacatgtgccagtgccaggtgttttctatatattatctcatttaattaacaccaataaccctacgaggtttttatcccctatgtcagatgagaaaactgaaactccctgagattgagtaatttccctgaagtcacagaggtagaaagcaccagagctgagatttgaattgcaggtttgtttagagcccacacagacactgatggacggacacttttgaggtcatataaccatatctattttccaggtgaggaagctgaggctcagaaaagtgaaacaactcaccaagaaaaatagatggctgggaaatggtagggcctaacaatgatctcagggcaatctacttccagcttgtatgtgctctccattagactatatggcactgcccatcgaggtagggtcattggactcattttatatatagggaaactgaggagcagaaagaaaaagcaacgctcatggaaggagactttgcaggggaggggaaacccctgagcctggtgggccctggcagaaggatccctaaacaggactgaaccaagatctatcagctaggggatccctgacccctgccagtcttctcctcagacattttcaggagcaagtagaatgaaacaaatgtcagaagcatccctgaaggaaaatgaagccccaaagcaaactgcaaccttagaggtgcgtgtaggaggcccagagcccactggacattttgcccctgctggttatgatatggcacgtgctgctgctgcttttgtagtaccacttgcaagtgccatcttgttgttccttccctgtcatcttcctgagttactgtccaactgagtccctgcagaagaggacagggcaaaaggcaatatgaattggaccagcacctcaattcacagtgtcctggtgatataagccctgcttctactcctgtagaatagtctgaagggctgagggtactctggaatcagattgggtgagtggcagcaggagagaagagcagggaactgcctctttttgcccagatgtggaggagtagctcatctggtccaagaggaaaagaggaaatcatcagaggaaaactggtaggatgagataaaaggcaactacggggcataaaaatcaatcttccagagacatagtggcttaggtggaagaacccaccaaacctccctccctgaaagccagggcaatatccgtactcagagggccgggaaatcaccctgaactgaaggccccaaataacccataatccccctatagaatcctccttgcccacctcaaggaggatgtaggggccctccctccaaccccccagggacccggaggagctacactagtgtccaaagaaggcagaggcagagcaaagcaaggcagcgtgccatctcccctcccagccgtgggggagctcctcggctctctctctctgtgcccccatggagatcacagacaccgtccggcaacctccacttctttctccttttttgaaaccattctcttgttgggggcaaaaaagatggcaaatttacacttgtcctccaaccctacacataattggtggcagcaggcaaaaccgctgcaaggggagggttttgccagtggaatgaaggagggagggcatcttagagtgacaaggatgggagggacctcaatcatctgacccagccttgctgtggcctccacaccattcccatgatctatgtgctcccatcccaaaggtcatctttgatgctatgcaaggttctccaggactcctcccccaggcttccttggggcactgccccctttccaccactgagtgaatccactaccctcttgttttctgaggaaactgaggcccattgacatatgacttgttcaaaagtaatcttcatcccaggataagaagtttgagtctgtttccatcctacttttccactgaatccctaggaaaggaagggctcagctcttctccctggtggacagcaccattgccaacaaagtcctccccttgccccagctgatgtgggcagccaatatggaaggtctcagaactgaatcacctttgaggagatcttggtcattgcctcttcctcctgggtacgctgagggctctgtgaggctagtctgggtcctagcagcatcttccctgtagaaaactggacctggcctggtctcattctgaacacagcctcacactccaagaaagtcttcatagcctttcaagaggtctttcctctttcccttacaatggaaggaaagaagatacagagtgggtgaacagtcaagaggcagcatccatggttggaagaccctgctccttctgcggtttgcccctgttttaaaaatatcctttctctttcctctgcttcccctcagttggaaggatgaagggttcagaatggaccagtcaggaccacctcttgaagcggggtgcaggtttggaggagcctcttgtacctgtctctatgtctctgtgtttatacacatagacatgattctgtggggtagctttcgcccctgtgctgaccacatgagagtgtctgtatgtgagtccatgtctctgcgggtagggtggttcattaggcttacctccaaggccttaactgcaagggagtctgccctggagctggcagttttagcaggcggaggctactttctttttggtcctcaaagtggactcgcatctaggaatggggactgagtcttgaggttgggggtgtggtaggtgtaaaagttgagaggttgttactcggcctggtgtcggaggcggtgtgttccgaggtcctatgtcccctgtcaggctgtgtcggtggacacgcccgagtgcccgtgtgtccgtgtgtccacgtctgccccagcctccccaacacctcgcaccctctttgtctcgggtggaggtgtgcgttcaaacctggcgccgcacggccgtcctcgcgagcgagcgcggggacgcaccctcgctccccgactctttcctaggggagcgaggacgagtcggagcccggtgctgtttggtctggagccgagcggagcttgcattgatccattgattgcgcgcggtctgcgcctgacctccctgctcccggggaagccgtctccatggagaccaggcccgctcccccatcgccggattgtaaattcctgcaggcagcggcccggcagcctggggagggggccaccgcgcccgggcgcgcagggggagcggccaccgcgccgaggccccatttgaaagaaaaaagggcacgaaaaaggaggtggtggagaaggaggaggaggaggaggaggaggagggggaggaggaagaaaacgaaaaggagcgaggagaggaggagaaagaggaggaggaggagaaaggcgaagaaaaagagcctgagagacggagaaagagcgagagaggaagaaagagaggcagaaagggcgtgtttctggcgctgcgtttcccctcccctttctcaggtccttcgctcgggctctgcgcgctctccggctgcagctctctcccggcgaagctgggaattgggtgggattacacggagcagccccgccgccgccgctggcagaggccggcttggagagggcgggggttcccctccgtcagtcgcccctggcgcccctcgcctcgtcgcactctccgcctcgctctccccgacgtccggccaggaggagccggtagcatcgggagcctcgcgccgagggcgccgcggtccgcgccccgcgactgcagcccccggcctggccccggcggggcgccccctcccctccccctcctgcgagctgggatccggccggcttccgccctcccctggccgcgagaccggccccggcggctgggccgccagtagctccagccatgggctcggggcgcgtacccgggctctgcctgcttgtcctgctggtccacgcccgcgccgcccagtacagcaaagccgcgcaaggtaaggaaggaggggcgcgcggcctgggggctgtcctggctgctgggcctcagggcctaggagcgattcccgaggggcagggcaggtgctggggagcgtgctgctgtcagaacccggctctgtgcacccggactccccggccaggggcccgaccgctgggcgctgcgccccgagcgaaaagccggacaagctgggggcggcagagaggagtgagaaactcttgggggcggtgggcagaagagaccacgcgcctcagaattccgctcgacttcatccactcccagcatcttcgaaagacttcttgtcttccaaaatctgagagagaattttctcttctctcaaacattgccagaaacttacgctgtggcctggagagactgagggaataatgaaaacttttcagccgtgccgtatatttctttcccttacccccaacccgcatgcaaagttagacatttctaagttgatgccttatcagtggaaaaatgttgaagaaaaataggatcttttatggaaaaatcaactcatctctcaccggatggtagggggctgaagaagagaagaaaatttctgtgactggctcccgacaggaatgttgcgtttctgcctctttggggtgaaatctctttcgtcttgcatggctttcatttcttatcataatatttatttattaaggcctcgggtttccaattccatttaaatccaggtcagaattgcattaaaataacaaagtagaattccaggccggggagctctgacagatccctctaggaattaaagagagacagggaggcctcccgcccccgtccctgacccccagctcatcgcctggcaggtcccaaggctgtgcaggcagagactaggctgatgtactacagttctctcgggacagtttctcctcccccttgacctcttgctgtacccctcccccatcgtgtcctcaccgacaagagatttatatggacaaaaagaaaattcctcctggcaaggttttgcccaggagagtatgattctgcctattgtcccaggggctcctgaagccagctgggtgaggagatggctgggccagaaggaaagttgaacttgggagttggggaagcctgagtgtccgacacaggtcgctgtgtcccagagcctgagcgtttggctcttaagctgctctgttgtattggatgggctcctgctctgtgaagaggaaggtgctgtatcaatgccgccctcctctccccaaacactgcctcttcagctaacctcttccccctccaacctgtcctttcacagaactgaaacactagagatcctcagctgtcaaatactggaccctgcccccacaccttccagccccacactgcctcttttccagtcctggttccagacagcgcatcgccactgccacccccaacctgggagcagcccctctcctcactgtggatttgtgttttcataaacaaagctggcttttgtagtgtgtgctgacttactcataacatggaattaggtggggagtttagtctgaaggaaggaacagatatcatgaagtaacctagagacaagataagggcctctttcaagttggagccagtgtctgtagtggcctagtgaggctgtggaccaaaggagaagcagtgtattcgaggggggcccaggggcagatggagacccctccaagggacaggtgccatcaagccaaggcactcaagtatgggagatcagctcatgattcaggaacgggagtcagaatccctgcatggtactccagggcttccactttcattggactccctgctgggtactgaggaacatgctgccagagtgaaggcccctgccctcaaggaacttagagtagtttttgtccccagcttatctcattcacaggccacccttcctgtgactggaccgcagttagcttggtatcctccttcttttcttctgatccctaagcttggcctagaatggaagcctttcattgacccttctcttcaggaaatctacaaaccccatctgccagaggttgcctaatagcaggtttgctgggttacagggatgtctctggacacaaacttgcaggcagatgctgcaggaagaactagtactgaccaggcggggcaaccttacagccttacccatagacacagtctgtgagcatcagggaggccttaccttcaaacatatctcctggttatcagcagtgccagaaagtgtgcctttaatgccacatgctttatataaagcactagcaggtctttaaaatcaaatacccttggcaagtatcttgcacggagttactatacctctgggggtatctgggtttctgtcccttttcatcagtgattcccacaatgggaaaaccaaagtcatgtggaaggggggaaagggggagacaaggaagggagccctaagtgtaaaggtgagtgtgcgactgtgcacacatgagaggttcaccacagttacccacaggcaacatagctggatgtctgtgtttcttgtgacgtagttgctaagggtaaactgctgttttagtgtctgtgagaactgtatggaagagtaggtgggtaagcctgtgtgactgggaagggagggagcatgaggggacatggttttgagtgtttttcaagtgcttgtctgtatattttaaagtagacagactggataaccaagataattgttaacttaaaagcattaatttgctttgcttttggtaagggggtgggtgtttggcggggggggggggggcgggggggaggcgcggcgggggggggggtgtgtgcagcagtggttaaaaagacctaatcctcgcatagggctcaggttacagctgaatgaaaaggtctctcggcctccagggaaacttgtccccagggctggctccaggagagccagcctggccgtttagtttacctggtagttttctctccttgttagggatagagttttgataaagtcatgcatttagaatttccaagtaaccccatccctgggactgagagcgttcatgtggtggcaaacagtgtctctctgtctcggtgtgtctctccgggtctctgtctgggtgtatgtgtctctttctttctcccacccttctcttcctctttaatgtggctgtttcctttcctccccgcttccctgggctcctgtggccagctcttacagtgaggggactgttcctactagcccctccctccaaaatatgaaatgaaaaccataaccatgtcagcgggtaagggtggccccgtgggcagccggctattgcctgtgccctgtccaggccacactggagagagggagagtccccactcagagcctgatctttagtcagttccctctaagcccacccccatttttccagaaggtggagaagagggtggactgcttagaaattcctcaggaatccctttgacctctcttctctcatgacatgtctcagaggtggggaaagcctcggggtgggagagtacagagacttttccctgttttcaaccccttccttctcatctctttgagtctctgcagggtggaataagagaaaggggactagaagacactaaggccagaattactgcaggcagagaaagaagacagtcatcagcagccctcaaatgagattgttttttgaaaccttcaggaatctgagagcatgagaaccggtttgagatgtgagcagctgggacctgttgtaagaggagccggccctgggtgtgagtttgggaatgtgaagtgtgcattcacacacgtgtgaatgtgtgtgcatgactcagggtgtgtgtgtgtgtgaagtgctctggtgagaggaaaaaggaagtggggcaatatgcattttgttttagttggagaagtaaagaagtggaatggcttggtccagtgccttgaactgaggacaggggaagggaacgaagggcttcagaccttttgagaagatggagctggaagagcttgctgcctgaactcactcagtcctttcccccagctctggtccccaaatgtcagggtgtgggcctcctttgacatcccgtatccctagcacatgaccacttataagaaagagtccctgtcagggctggaaactgcagagctgctctgaggctggcagtgcctgcaagaggcccagacctggggacagcttcttcaggctcagaagactggagtctggaaacagaaggactgctgggccttgggtatagaagcgaaacaacggccaacccagggatgtctagggggtacaggagctagtcacctgggctaagaggggacagagactcccctcccccactggccacttaacattggactggctactctcctgttcctatgcccacccaatgccagcctcaagtggcaccggggatatagaggtatatggtgccagtgggtttagacaaatgcagagcctaaggatttgagcctcggaggaaatcactgaaatccctcttctcacttgtaaaatatcagtagggttccctgcagccctgagattctgcacatctcactgaaatccttcctgctgaaggcagaaggcgccgggcctccacaggttactcacccaaatctcaggcgctctcctccttggatgctggtccacttctgcctgcctgaggctaggtcatctggatactcttcctttcttcccccaccccagtttcctggaaccccaagtagctgatagttcttactgtgtccatgaagtgggtatttatccctggaaatagcccctgaagaacacatgtgtgtttctatatgtgtgtatccaacaaagttgggaagtggagctgaaatatccgtgttatgggaactgaatattcttggatctgggccccaggattccgtgtttctagctctgagactagctgtctgtattctgccctagcctagacatgtccccctgcagatcaagcactgctttgtagttgctgttagatgctgtgctttggctgaacaaatgggatgatgacccctatatagggcacagtggtccttgctcttacctctggttttccctgtggttataaccatagccctagagagctgtggggtttggatttctgagcctacaccaggggctcttcaggtctggtcactggtggtaacaagctgaggaaagacctgggcaggggctgcagggctggagggaagatccaggataaggaaacacatctaaggaatccctctgaaagtggggagtatcaggatatgtgggcattggggggagggctggggaaggggagtgcttgaagggtagaccctggggagcaggtttacagagaggacgtttttacaagtttctaattatatttatttggagttttcctctggcggtttgaagctgttaacagcaggaacctgtatccctggtgtttgtttttgtttctaaccagctgcttggccccagcatagtgaatccaagggcaggcaacacctgcccactgttgcattgcccaccctttccttattgcaactgtgtctgtaccctccctgcccactactcagccttgctctcttctgctgctcccatgcccaaagcctcagagcatctgcattcccactgctgatttcctccctggatcatgtacatttcagctccttccgctccacggttatatactggatgcatgcttcatgctgaactaagtgctgaggtggagttgggggaggtacaataatgactaaggcatggattcctccctcaagtgcttagagaacacagtgggtagttagagagcactggactgggagtttgaagacctggatcctggctttacactagctacttgctctttcctgaggtatcctcactgggccccagatgagagaggacagtttgaagaccacgtgaaccaacctgcatgaaaaaactgtacacttagtgaaattatacgaatctgaaatgagtttatttttttcaattaaagagataatattactaatcacaaaaccagaacctacccatgcccactgcctgcctctctgcccctcactctacaatgttctgttcttcccccacttcactacccatcctctaaaagtctctgattcatggttgttgattttgtccatactgaaagggagaaaattcttgtccaattagggttacattcaaatgatcagggagctagattagggataaggcaggacaacagagagaaactcatcagggtccccagtaagtgacaagcttctgaggttcagacccccttcccttcaaatcaccaaacaccagcagcttttcctggctgttcagttgagcaggctaagcttgagtgagaggagaggatactgtttttaaaaggagaaagtgctctgtctccgccttggaatcaacaggtggtcatttgtgtggttttctggactttctctaggctaccctcatccttgcataagctttttctagactgaggatgggcccagactctcactgaagtcacagtgcctcagccagtcccaaactgggaagacagcctggtactccaggctctgccaatctccctggttgctattttgatctggaggtagagcagatatgcagatgtgggtacatgtgcacatgctgtgggttaggatatcatggcccaaggctgggctggttttattttggatgttacttagaggtgagaatgagggaaatcaccaggggcaagcagtggaatgcctgtgtcaggtgccccatcattgagagttagcatggaggctgaggaacatctgttgaaggggatgctctgaaaagatccctgtagcagccccatatgatgtctgaagaccctgagaccctatgactcattggttccagtctcttctggccccagcactcatcatatggatgcctttaagtgggtactacccctctgaatttagtttcctctctccctactctccacttgagactaaacttcctgggacttcccccatccagaacagttgtgggatcacggagagtaaagaagtgagatttttctctgaggtaacatagagcagaagggatgccacagatagagacattatccactcactactaatgcatccatgtctccatccactcgtctatctgtttaacaaatatttactaagtggcttcaatgtagaattcatctctggttcactgccaaatccccagcacctagcacggtgcttcgcatgttggaggtgctcaataactattgagtgagtgagtgaatgaatgaatgctgagctctatttcagttgctgcatgggtttcaaagctttaggagccatggcctcaagctcctactgcttcagtaggaaaattatacacatgaactaaaagttaaataatggtacaaggtagcatatgaggtatcacaagcctgggattgatcaggtgaccagagagcctgacagtaagtcttaggagtcaagagaaagagtagatcagagaaggctggtagtgtcacagggagtgtcccagcagaggcacctgaactgggtcctcaaggacattcaaggagaggaaaatagcagagtgcgctacacacaccatatatcctgggctagcctggctgggctgaggatgtcacagctatgtgggtgggtacattagggctctaggcaggctgtttctgactgtcccactgggcccatcaaatttgcccacaattaccccctcccctatgggtggtaaggtaataattcctgtggtaatgggaaggtggggtggactctacctagggggtctgcttgtccacagccggcatccctgctcatttccatttgttactgttcctgagctgggcttgggcaaacttgtgaagtagatgaagtatttacttgggaatcccactgcttcccttttagggtacacctgcccatcctcagaatcttaggactacttgttttataataatccaccctttctggtctgaccctctgaccctcatatcccataccccatcctacccttcctacctactttaggagagtttatggagtgctctgctaggcgctaaagcaaattcagaagaaatgtcagatggtactgggaaaagctgctgtagttacagacctgtgccttcatgccaggacagggcgaggcagggaggtcttggcttgtctatggtatctgtgcagccaccactctcccccacctcaactttggttccaatgcatggcctgaagtaggagtgggatctccctagccttcaaaaagaattgtagaggacagcttttgggttcccaactggcctctcacccacttcacccccattctttgtgcagttcccagcacaggtagagtaagcagtggggatgtgtctccccaaatcctccccaccaacacatgctcacctggtgctgcatttccccacaccaggcctgaaatggggctttgatagggaaagggagttcagaaagaatacagggagaaggttggagagaaggaataatagtagcaaaccttggctaggcatggcgactcacacctgtaataccagcactttgggaggctgacatgagagggtcgttcaaatccaggagttcgagaccagcttgggcaacatagcaagaccctgcctctaaaaattttaaaaaattggctgagcatgatgccacgcgcatatagtcccagttactcagtaggctgaggtgggaggatcacttgagcccaggatttcgaggttgcagtgagctatgttcatgccattgcattcctgcctggataagcagagcaagaccctgtctctgtttcaaaaagaaagaaaaaaatagcaaacctttgttgagcactttctatatgcccacactgtggtgttaagtacttgatgggtattaattcaactgatgttcctggaagccccatggggaggtactatgatgaatattattcccacatacagaggagggaacaggtaagttcagaggctggcccaggaccacacagacacaggtagagctagcaattgaactgacaatgttgctccagaacctctctcttaactactctgtcatgtggctgccctggtctcttcccagcttgggcaaatagtttattggcattaccttgggaaaggaagacagatagtagccacagcctcaccctggagatcctgattcagctggtctaggggacatctgtacattcacatttttttcaaaacccccagggaattccagtgtgtagccccagggttgagaaccgctggtttaaaccagtccacacccagtagcatcaactggttttccagctagtaagcacctgcatcctgagagaacaggctaagatgagactgtgctgtgagcgttgaagggtccttgcaaggacaaattctgggtgggcacatatggtaggagagaactctggaagaatgagtggtaaaaggaggagatactgggtataatttggggccctctttcacagctttgtcttaggtctgttctgcttcaaaagactccaaccaaacattgaagggacatcttcctcagcaggtacccagccaggtgaggaaagctgaacacgctttaaagtattagcagagcaattcagtgacggctgtaaatgaactgaggagaacagtccccttggaccaggaactcaccaggaacggggcttacaaggaagagcttttgggaagaaaaatttgagctggaatggaaagctgagcatagtgtggctggaagagaaaaatgaggaatgcatctgcaatgtgaataacgaaaatacgcaaatgcatagaaaggaataggatggttaggtattgtagagggaacaggaagagataatgtcttccagagcagagactctttgctggagagggataagcattgtgagcagggaggtaagggagaggggttagttagatggtgggagaagtctggctgtaggaggggtctaaaaaatctgtggccaggtgtagtggctcgcgcctgtaatcccagcactttgggaggctaaggcgggcagatcacttgaggtcaggagttcgagaccagcctggccaatgtggcaaaaccatgtctctattaataatacaaaaattagccaagtgtggtggcacatgcctgtaatcccagatactcaggaggctgaggcagaagaatagcttgaacctgggaggcagaggttgcagtgagccgagatcacaccactactgtactccagcctgggtgacagaccgagacttcatctcaaaaaaaaaaaaaaaaaaaaaaaaaagaatctgctgggaggcctgggtttgtggtgatcagcatcaagatccactctagtactggtgagcactgaatgggaggcaaaggaaagaattgggagcccatatagtctgacacagtctctagtgaagcaccagctgattcagtcacaggcacatacctctgatatggtcaggggagcagttccagaccagtatccgtgctgctggacccagggagtatctcttattcagaaccccagagcagtgctatcctgtggtgtgctaatagcagtgctatttctgtggtgttggaaatgttccatatctatgctttccgccatggtagccactagccacatgtggctattgcgcatttggcctgtggctagtgcaactgaggaagtgaattttaaattaaataaccacatgtggctagtggctgtcatactgtctcgagcatctattgcctgaccagtgatttaataccatctcaagcttcctgtattgggaccctactgtttaccagatactttattagccaatttacacaaattatcccatcagctactcacagcctctcatgaggaggtattatcatccccattttaagggggaggagatggagaataagaaaaccatccctagagaagggtagagctggatttgaatctgggactgactggttccagtgcttaagatcgttctgtgatagcacatttctttgtactgttttctgtttatcagttggacaaactgattctccacagagcaccttaccatctgcgaggtccctcttgcccttacctatgaactagtcttccatgccctctcttttccattctgtcacgttgggatgacttcccaggatgggccagcaggtagacaccatgcctatggagcctgagcgaggtggagagtaagtgtagacagaggctcccagcacttagaatcaactggtatgatggttggctgcataggagttgaagggtagaatgaagagctgaacggaaacctgtgagatttgaggcagggtgtttggggatttcagttctcttcttagccccaggaagtttcagagtataaaagcggaggacagataactgtctcaagctaggactctgggtatctataaattggagagaatactggtccatgcatccattcactcagtaaaaataatcacttaaggatttggattcaaaaaggctataatgagtcctgagaatctgcattttaataaaacctaggcaattctatggcccatagatcacacttggatatcaaattgtcttggtgtcaaatctcatctcctttctgtgctcagttgtgggatcacaggagagtaatgcctcccattcagtgatcactcacttgcaggctgctacttaagacactattttgggtttcccagtttccagctggaagtaatctctttctcctctgatctgccccgtaacacaggttctcaaccttgactacacattagaataactggaagagctttagaaaaatactgatggcccggcaccagtccaggctatctgaccagaatctctggggttgtggcttggacatctcctaggagagttgactctgatgtgcagggtggaggaccccctcaccttatctctcatgtcttcagggcatgtaccacattctgctccatgttttttgtttctccttttggctgggctgagtcacctttgagcctccacagctatcattatagtgtctttcacaaacacactcaataaggcgttttcaactgaataacatgtttctctatttcagttcagatttaagggcaccataatattgcctcagaagttggactcttttctatgtccttttttttttttttttttttttgagatagagtctcactgtcgcccaggctggagtgcattagcgcgatctcagctcactgcaacctccgcctccctggttcaagcgattctcctgccacagcctcctgagtagctgggattacaggcacacatcaccacacctggctaatttttgtatttttagtagagatggggtttcatcaaggtcaggctggtctcgaactcctgacctcatgatccacctgccttggcctcccaaagtgctgggattacaggcatgagccaccgcgcctggcatcatctatgtcctttcctaaccatcctcttttttgctagatggtgagtggcctcttccttcaagtatagctgtgtgtgtagcacctattgttagagctagggccaggagacagagggctaaacactggggattagggcctgaagggctgcacttattaggcttcaggtagctggtgccaacctctgccagctctggatgtctccattgttggcagcacaggggccgaggaaaatcatccaggatggaacatttttcctctaaagcttcttggctccatggtgggcaagtggaagcaggcctggtctcaagcagaatcatgacacagatgaagatccctcagatgccccatccccctttcttcctcctttactagtgattgctggaccctgccaccttcccagagaccactgttcccatgccttttcccttaactttccctctaagccttctccgtaaactcattcactttaagttgattattcctaatcaagttaagtgtactacccactctaagggttttttgtttgttttcaaataaaaaaaggagtgtttcgaatgatggagttttagctgtcactgtgaatttagtatttttgagggcagtgggggttccttctgaattcccaaaatcagtgtctgcctactctgaaatcagagagatgtgagacagcacctgtttctggagggggtcactgcctctgttttagagaagaggggattctgcccttggaagcccaccttcaagacaccccttaagaggtgccaacagaggttctcatgtgccccctctgcccctgccagatgtggatgagtgtgtggaggggactgacaactgccacatcgatgctatctgccagaacaccccgaggtcatacaagtgcatctgcaagtctggctacacaggggacggcaaacactgcaaaggtgaggctggaagggcacctggaggagagggacctgtggaagaaggcaaaccagtgccactgccctcagttggccactctccatcacatcaaggctagaaattccactggtcaagtggtgggggggtggtgaggggggcaactgcatcttcccagagagggtgccattttctaatttgcacaaaggcaccatgcaggctagcagaggccctggtggggacagttcacagcccacaacctggctggggtgggagcatgaaaatcataagactaagacctgaggttccctgacattggaacctttatctttagacccttacaccacatccacaatggatgggaacagaaagtgtgcttcagaggaagttcataatgtaaacacatcttcccctcataattaaatcaatgcaaattaaagtagccttgagatattaaatttatgagcttcagtgttggtgagactttagtggacagggtacacttgttaattcctagttgcattataaattgaaaagtaattttgtaatacctaccaggaatcttaaaaggtatttcctttgatccaggaattttactcttggggacttattcaaagtaacaaaataatacatgggagaagatgttctttgatgcattatctatgatggtaaaataaattaaagaaatctaaatctctaacaatagagaaaaaaatagaaaaataatattctgcaaccatgtacaatggtaattagaaagactggatggagacctgaaaatgttcatgacttaggtttaaatgaaaacagaaaaatgctaaatggcttataggccatgaacataactatgtaaacacaaccataaggctgagtctgggggtggacagtgggttcgcaggtgggttcagctgtctcagcttccctttgcccacagacgtggatgagtgcgagcgagaggataatgcaggttgtgtgcatgactgtgtcaacatccctggcaattaccggtgtacctgctatgatggattccacctggcacatgacggacacaactgtctgggtaagcaaaggagaggggatttggtggagggatgtcttgtggagaaagagatcttttcagcatttcctatttcccagggaaggaggagagagtgatcaagaagagctacattcacaagagaataaggtcagcctcccctttgagactggccacttaggatgaaaaatcctgctggatgaaaaacattagaggaaaagctgctacgaaatgctcctagggcaagggccaggagatgggaatagtgggtttagccagtggtgaggcatggtaggaagctgatttggctccacacagatatcttggttctgctgcttactagccttgggtcttgggcaaatcagccaatctctggaaatctcatctttctcctctctaaaatgggggtgggaccaggtgtggtagctcacacctgtaatcccagcactttgggaggccgaggcagagggactgctagagcccaggagttcaagacaggcctgggcaacatagtgagaccctgtttctacaaaaaataataataataaaaattagtcagtcatgatggtgcatacctgtagtccccagctacttgggagctcttccttggcttgagcctaggaagtcgaggctgcagttagctgtgattgtgtcactgcgctccagatcgagcaatcttatctcaaaaaataacaataaaatagaatggggtggtaataacccacttgaaggctgctgtgcggatcaccacaagacaacatatgaaaagagccctgtacaatccttagcacatggtaggagctcagtaatgggaagaatgtttttgatgatgacgacagtgcatccctatgccccaggaagcctctgacccttacaggcttgttttctcccagttcttcctgcaatctccagtctcaccctctcctcactgatctcctttgtcccaggagctggatcagagataagagaatctctaaggaactgaactcaactttggtctctgtcattttggaaaattactgggaccaagtcagactcttccccaagcagaaaatctgaagctcatagcagaaaaggatttgaaatttgaacccagggccttctcccaaattacttcaccctgtagccacaacagaaaacaggcactagaagcataaaggaccaggaaaggaagagaaacaaaaggaatgatgcccagaaaagcaggctgggctggtcctcacccaccaattgaccaaatagatgaattctcttaagtcctattggctgagaagagcctccttactgcagagctgcctccaaacctagtcataacccatcattggacccaggctataggtttctacacccaaccctggcctccaaaccctgatatctgctgggcccttaatcccagccctggtcacctctcctaccattttagcttccagggaagggcctcatatctgcccagtcacccttgagggcctcttatgaaactcctttgggaagggaagctgtggcacttagaccaggacagtgagttgcctacaggacatgcacataagcttctgagttctttggctgcctttgacttttctaggcccctgattgtcaccacatctcatttccctataagtgttttggggagaaccaaccagagggacaagagaatgattaggtatagagagggtcaagggacaaagattacctagggttagggttcaaagtctcaatactacctttggctcttaggggaattttgagaaagttgtccatgctctgggccttagcttccccactgagaattggaggaaagagcttggctagagtagcaaagccacaaggttagatagtaagggagcagacagaaggatggcatgtagaatgtggcaagagcaggaagacagggatggggagaagtcaagagaacagcaaaagacagggtagagacaggagcaaagcacaggaaagtacaccttagctcttccaacaggtgcatctcttgggcaagagccagctggatctgggcctctctgccctggccagaaggggaagagaaggttgcaggatctcagcagagaggatgggaagagaggggcagatgaagccctcaggagcccagattctagctgctccatttgacaaccaatctacgtgatgcctcctgggccaaggcaaactgagaagggccatggacttgggagggcagtagctagcatagagatggaatcaaggtgttgaattgggggctccagggtgagcttggctctagaacctaggggtggtgatttgggggtgagagcctactgttctccctgccccccacccccaccatctagggtgtggcctggcagctctccccagatccctccccgccaagttgtcagactttgttttgttaagccaaaataggagaaaggctagggaatatggcagcaagcccaggcacaggggggaggggaggaaggacagggctgtggcctgtccacagaaatggtccctgctccacaaggaggtgaggctcagctgcctttccccaccctgcccctccaacctcagcaccatggccatagctctgcctgcacccagagccacttcccaggttcctacattccctggctgctcattgcaaccagctgcaacccccagttacctatccgaccaatgtgaccaatctccatccttaccttcatcactgttcctctttctctggcttctttcctggtgtcctctgtcttcatacccagtttacacaggtgagggaaagggaggcatggcttcacctaggtgacatttgaggttcaaaggtccccttttcccccacttgcttagcttcccagctctgccctcagggcagcctttttacacttagtgaaatattagctgacaagggtgtgaggacttcctggcttaaggctgggcttagggggtagtagttcttaagactgcctttggtgctgaagtcttgggatataccctggaccctgcctgtaccccatgaccccactgactacctatcctgcacagatgtggacgagtgtgccgagggcaacggcggctgtcagcagagctgtgtcaacatgatgggcagctatgagtgccactgccgggaaggcttcttcctcagcgacaaccagcatacctgtatccagcggccagaaggtcagcccatgacctgggatggccccatccctgccctccccaggcttctcttcccagctgtccctcagcagcccctaagtctcaccctccattctcaactcagctagctccttcttctcttgtccttcaactcaatcacaccctaaaggatctaggaacagacaccctgttagggcaaaatctggggaaattactttgaggttgggatcaatatgggattaaggctactatggagtatcctctgtgtccagacctgaggtggatgttgtccctaattgtagatggctgagcttctctaagctgctgcctatctgagagggcctcaccatatctttttccttggattggcatgggagggtcaggcaggaataatgggtttatattggctgtttctatgactcatgccccccactcccactagactgtgacatccctgagggcagggactatgtctaactcattgttgtatccccagcacctaacatactgccctgcgtgtagtgagagtttaataaatgtttgttgaataaaattgcatagtaaatatctataccaattaccctccactctcattgtagatctgattgctactgatcttcttcccagtttgactgtaagctctttgaggggagtgatcacaccttgtatttttctaggaccttcctaaatccaccccatctccagcacagtgctggacacctattatacacaatgttttggttgtttaaaggaaagggtgatcattcgttgggatgagtatcaatagctagctagttatacatcattcagaacagctctgtgctctgctcatgagcacccaggtctgtggggaagacaggaggcctgggacaaggagagtcagtcccctcgtgttgaattcaacctcagtagaattctcccagttccctaggtccccagttgccccctgtagtttttcttttctagacatccaggggtacagagcattcacacccctttcttctcttttagaaggaatgaattgcatgaacaagaaccacggctgtgcccacatttgccgggagacacccaaggggggtattgcctgtgaatgccgtcctggctttgagcttaccaagaaccaacgggactgtaaatgtgagataattgggatggcaggtggggcagtggggtcgggggtgaaaacatagaggaagggtatagggcttcaggagcaagaggacagggctgggaggaaaagggagtatgggggaggcaactaggcaagggggccagtacccacattgtggaaaactgtggatgcagggaggagcaagctgacagggccctgtcctctctgtgcacagtgacatgcaactatggtaacggcggctgccagcacacgtgtgatgacacagagcagggtccccggtgcggctgccatatcaagtttgtgctccataccgacgggaagacatgcatcggtgggtgaggccaggggagaactcagtccacctgagatggggtgggggtgggaccctttgggaaccagggaagtggaggagtgcatggggcccaggtgctgggcacagagggactggtgagggagttaagacccagaaaatgccaggtctagtaagggacaactcaaagagagactgaagggctccccagccctcttcccctccccatcccagtggttttaccaccctgttccaggagcctcaccaccctcttcatcccaggacaaagtgttgccaaactgggaataattagcagagttgcttattgaccaaggctgtagttgagaagtgggaagagatctggggaaatgcatctgcttaggcctgaccagaggcccttggttgactagtgtgataacagaggaattatcaaagcccagtgtccccactctgcaactgagggtgggacagagtgctccttcctggaacaaccatccctgaactgactgacagatggggtttcctggctccaggtatctttttcctctttattccttctctcctcactctcctcctgcaactcccctttctactcacctcaccttaccccccatttccttctctctcctccagatgccagtggtactccctctcagctccaccagcaaccctgtttcttcctcaccaactccagccttccatctcttaccttgatttgaggtcctcttaatacctggatccctcttcctgaattcttaggccttatctcacatattttcaggtaccctagatgagtttaattccttaaagttaattcctaattcctttagcctttaggtctttagtgctgagaaggatgatggaacaaggtttccccttggagaagggggaaatgaaaggaagaggtttggctgagagagaggctgtgtctttagccaggcagggcatgagcttgctgtgtgggcataggtgtttatgaatgactgtccatctggtgggctgtggcatgctgaggatgggggtgtgtgaatccagtcactgtgtatgaagttatgtatatcagagacatgacattaactgaggaactagactttccagggacctgtccctttcactgcaggaataggaactggagagcagatgatgctcttacagggctccctcaggcacttgctccagagactggcacatccatttctaaagtccctatataattaaaatctcccctgccacgtttccctctgaattaactcttcaaagaccccagaacatttttaggctcttctcattgccttctttgggctggtgtgtttcagctcctttcattttttactcataggtctaattattttgcttttcaaagctctcaccacctcctggacacattcacacatccccagtctctcaaaagaaattgtttgcagtgcccaaagaaaagatgcatgagtcaggggccagggatgtgaaggtctgatccctctctgatttatttctgttcaaagttccagacatggttgcttctgaaaacacccttactgagcttgggctcttctctaactcaagacctgttccaccactgggctgtggccaaatgaggcagaaaaggccaaatgaggcagaaaagaccaaatgaggctattctggggtttacagctatattctttcctagttcctcttcctcttctccaatagaacttattttaccttgccatatatctaatttttctggccatccctggtaagaggaaacatcattgcctggggccgtcaggacattcagattcggtgggaagactgagaaggcagtatagtttagcagaaagggcggcaccctttgggatttgggattttgtggttagtaagacttgagggtgcatcccagcttaggcttgagcatgctctgtggtactgggcacatggttggttgccctttctgagactgtttcagtttttcagtcacttgcggggagcttggcatctttggggataccaccagacaggataaggatgaggagtgaagctgtcataagggtcccagggctcatcatttggggctactggtttgggctggcagtggggaggagagggtggggaggggtccggggccagagggccacagtggcttctgcccagcacctaaacagcttttttacaatgtcaaacaggggaaaggcggctagagcagcacatccccactcaagccgtttctaatggtaaatatgtctgctctctccgcttgctctcactggcttgctaggggaagggctaacccgctggggctcccactaactgcatgcccactgggcccagcctgactgggccccaacttgccagcagggctatcctggcagccagggcactgggcccattgggtgacaagaaacctgagtccctaagagctggcccgggagctttcatgttggtctcgtctttgttcctgtcactctccttctgcccttcctcttctgctgtctcctcccacacccaccttctaacaccccaccccactcccagccatctgctccccacccccctctacccagccagcctcatcttccctgtcatgcccactgtgccacctgagataggggtgcgataggattagatgccatcccctccttggggcttctttcttgggttcttacccacattagttcacagtcccagcatcactcaccattctctcctaccgtaatggctaagagcatggcatgtgtgttcaggcagacctgagtttgaatcctggctctgttactttctaactgtatgaccttaggcaagctactttcctctctgatcctcagtttacttttctataaaataacagtccttccttagggttgtaatgcttgagatagtgcatgtagagcatctacctggcaagtgcctggcacagcataagcacagagtaacttgtggttttaatattgtgacctagagagcaaaggggtgagactatatggtcctgctgccccaccctgctctcaagaatgccgtcctgcacaggtgggcggctatgcccagctttctgtccagcctgggatggacattgtgccagctctgctattccgtatcctacatccttcagaagctatctggccttggcataagatctctgtgcccctccccctgctcctgggcttagtggacctcttcttatgctaaaagcactctttagcgggtggctagccttggaacctgaactcaatgttccctactaggttcctcccatggtcttggagagcctcaggagagactaaagtggaaatggcacagacgatatcccactccaggttgggctgttccacacatgggcatttgagggaccagggcatggccagggacccatagagttaggcttcttttggagccctggccttcctgttctcattggtgacaagagttgggcctgagtgtggggagtcagagacttaagaagatgacagtacatccagtactggtcttattcaattcccttgattctgagaaccattcttctatcttccctagtggaggtcttgggattctttctctctaatgggagaattctagtcaccccaagaggacagtatgcaccacctccacagtctctgtatcaggggccttcactgtttgaactaatggcttttccttggacacatctgactttcccaagctaccatttaaacctgtttttctcctgctgtgaattcagaaaatagggagagtgacccatcgacactcctcctactctgaccttttagtgaaagggaaaacttaccagttaagagggagcagcataagagacttagctaaaataaggatttaggtcttatctagctctgaggttctctaactctttcactaacctttttacacccttccttctcctctggattcttctctttcttttgcttctcccctctcctatacaacatctccccattagcagagtaaaacaacaaaacagccagcttatctccatctagaactaaaaggagggtttgggaggagttgaaggtagattaacccagtatgtgctacctcctctgaggatgagcagtcagtcgatcctggaagtgggatctttcttaagacagctaggcagcggggaaggggaagataaattgatgggtatccttcagttgccttaggaatggcccggctcattctttccaatccacttacaataagattgtcccaccacaatccccacccacccaccaaagacatagtggaaagaggaagaaactcctatctgtcccttctggttccctggcagccagaaccaccctcacttagctcccatccctccctactgccccccgccccacctcctccaccccctcggcacattcctgcctgacagctctggcttgtacctgcctcactgctgtccaccttgtttcaatcaagtagggggcagggaagtggactgcttggctgtacttgtgaggggatgggggttgggagtgatgggaggaaaggggctgggagcctcccttggcttaatgctccttctaaagcacagagaggcagctgaggccttccctcgggcctctgtggtctccactaccctcagagtttgggactcctccaggcttgtaacctcattaccatcccccacttccctcctaaacagagacctgtgctgtcaacaacgggggctgtgacagtaagtgccatgatgcagcgactggtgtccactgcacctgccctgtgggcttcatgctgcagccagacaggaagacgtgcaaaggtaaggactttgagaggacagaagcagagtgacctttggtaaggggctgaggttgggaccagagatagggtgcctattaggggatgacacctcctcaacctccttcttatgaagaacccaggacatagctaagggttgtctcctatctgcctgtttcatctcagttcaagggacagagaagtccagccagttccttagtgcccccttcccctaccccaccttgtttccctactctcattcctatcccccatgggtccctaaccctcttagttaatggacatgcgattcacatttgctcctgggtctggaaggatatttgagccctgactgtgtgtgtgcatgaggtcacaggtgtgttccataaccttcttaccccacattcctcagaccttcccagtgggctctggggaaatgatgtctacccctcgaaaggctgtactggtcaaagggagagtaggatactagttaggaggactgaagctgggttcagatcccagccctgtctcctactagctctgtgatcctggacaagtcacttaatgtctctgtgcctcagttttccatagtgctcgcctcatactgtgttgtgattaaaagagtgattacataaaaagtacttagaacagtgcttggcaaatggaaacactttgtgttaactgttattacagtatagttacccacattatgcattctgtttcccttccttttaattagccaggtctgagggagaatggggggaaagggtggaggaaaaaggcagggtagccatactgaaaatgatgattcattaggtccatatcccctggtcacaaggagtggggacgaggaggactgggctcgttctttgtgtcttttggcccaacagctgcgagaggaggggggaggctagggcagcaggtcagccagccagagttgagaggtttcctgctgggaagaactgttgacaggtatgctaagagtgaagtgaaaggctgccctccctgccccttcccccaaccaggggtgagtagcctgggtcctgtctgccaccagcttggggaacttgacctcaggaaggaagccattcaccagcccccctttcccttactagtgctgaaagctgcctcaggcctgagtctctccagatctctcccagtccagccccttgcctggcccccagccctcccccatcagctacccagcctcactggctctcctggaggtcctccctgcctggcctctttcccagctcctcctcctccctaaagggctgcccgttttcagtgagtccctttagaccctccacctctccttgccccgcacccccccaaccccccgtcctgagggacaggaaagagataacccttacccaccaacctttcagggaatggccatcagctggagactaagggctagcctgttaggtcaaatgcccacctgcccctcctctaggtaattccctgagggcctgttcctagttttggttccaatttgtccccttataagaacactcaatcccagaagagagggtgttactaatggccacagatcccctgaacagggaagaaacagagacaggaaagagagagagagacaggaaagagaaagagaaagagacagagagagatcaagaagaggcaggcccaggactccttgatttttgcatgtctctgtcagtgagggagggatctttctccttgtttgttctcagcctttgatagtatcttttatcctgttttgtcctccttcttcagatatagatgagtgccgcttaaacaacgggggctgtgaccatatttgccgcaacacagtgggcagcttcgaatgcagttgcaagaaaggctataagcttctcatcaatgagaggaactgccagggtgagcagactcagccaaaggtgaaagccttaggagaggttcttgtgggagagcttcaaggaggccagagggctaaagtcttagaaactcaatagatatcacacagagtctctagaggcagtgtcatcctgcaaattagcaaatggtactctttcccctcagcggactagctccatatcaaagcattcagcctggcaaggactgagggatggatttcaccccaattcatatccttggcagagtaggacgtacctaaccacacatggtgggccctgacctaaaggcaccagatcttgcagttcctaattccaaggacttcaaatagagggggcagagaagatggaatggcattgttaaatcactggtcctagagctaggacatgaataggaactcttcagttcaagggggaaagccaaggcccctcacttgggtccttcacctgagcaagggtcaagtgctccaagacagattcagtggcttgaatctttgctcttccagatatagacgagtgttcctttgatcgaacctgtgaccacatatgtgtcaacacaccaggaagcttccagtgtctctgccatcgtggctacctgttgtatggtatcacccactgtgggggtaagctagtaagcttgcacccccagccaccctggccccctcacctcttcaccctccaattgaacaggtccttgtgttggcttgtggctatgggcaatccctggatgcatgcaccatgtctgcatccgctgtgacaaaataggaggaattaagacagcttttgaagaactgggagactgcggaaacagcatcctgcctccaaaattcctatctcccattcctataactgtccctgaacccccactctcagctcccaaatgacagtctcactggttgggaggagtggaaggctttaaaaagcttgttggcttggccccttctcgatcattcctttggggacagagataattggaggaggtttgagctcttctcaggccagtagtcatcttacagtgcctagaatgcctttttaacttttttaaattgtaagaatatttaacaagagatctaccctcttaagtttttaagtgtacactacagtatttatgtgcctataggcacactgttgtacagtagatctctcgaacttattcatcttgcgtaatgcagggtacctgaaactctaaccaaaggccctcactcactgcctactctccggctcctcctccaactccatcgttgtttttctgtctccctactccttcccccagatgtggatgaatgcagcatcaaccggggaggttgccgctttggctgcatcaacactcctggcagctaccagtgtacctgcccagcaggccagggtcggctgcactggaatggcaaagattgcacaggtgggcagtgccctctgctggccaaagatgacactgccatttcagggagcagttggggttctggaaagcatagagtatcacattggggaaaggtgtgaggtggaaagggtggagaatgtagccattttgagttaaagacatgaaatttgtagtaaacaatcccatcatcagtctccatgggtacaacaatagttatgcaagtagctgattcctccaaattacccaactgagggaaaggaatgcattcatttgctcaggcctctctccccttcctagagccactgaagtgtcagggcagtcctggggcctcgaaagccatgctcagctgcaaccggtctggcaagaaggacacctgtgccctgacctgtccctccagggcccgatttttgccaggtacatgggaggagggtgctggagagctttggaggagaaaagaggaaggactggccgttcaggcagctccttcattccccctggattcctccagccagcgggggttgggaaggcaggtcagaactgtgacaggctccttttctcagagtctgagaatggcttcacggtgagctgtgggacccccagccccagggctgctccagcccgagctggccacaatgggaacagcaccaactccaaccactgccatggtaagcaccagcccagaagccctgttcccaccctactctcttacattaatcccttatttttgttcttcatcaatcccctggccttcctttctcctggatcctcttttttgccctgtaattctccaaccctgctccctcactccctctgccctaacatctgatccccttgactttcataatctcactcccccagccaagcccctggcttattacccagcttctcaacaacccctacggcacccccgacctccatgggcatcccatactgtgctgagtttctaccatccctctagaggctgcagtgctgtccattaaacaacgggcctccttcaagatcaaggatgccaaatgccgtttgcacctgcgaaacaaaggcaaaacagaggaggctggcagaatcacagggccaggtttggactggggaccccattccagttggctgtctggccactaaatcctccttacccctcagctcctctgcttccaaaaacccaccagaaccctgaactctaggcagagcagaggaaaaagcagctgtaggcatagcacccaaggaagtcccagaatattcccctccaccaactaattaggaccctagactaaaacaggattgagagatagttacagttagagatctggggaggtctgtctgggctgggagtgagaactttccaggggatgtccctggggttgacaagccctctctcccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacaggtgggactgggggcactgttgggaagaggactggaaggggagggcagaggtggggaaaccacaggtctcagcagcaaaaggaagggatggagcctgtactaggggcagaccctgcctggtgccaagcctaaaagctagtccctcttaccatgcccctcctagctcccagctttgctcccctgccctcctgctcacagcaactctttctcctccctgatacacacggccatccaccaccagccagctgtgggctgccctgcctccgacagcgaatggaacggcggctgaaaggatccctgaagatgctcagaaagtccatcaaccaggaccgcttcctgctgcgcctggcaggccttgattatgagctggcccacaagccgggcctggtagccggggagcgagcagagccgatggagtcctgtaggcccgggcagcaccgtgctgggaccaagtgtggtaagggagcttactggggagcagggatgtaggaaagacccagtttgggcctgactcagagcaggaccctttgtggcctcagatgcatttctcaaattatgaggcagccaggatgctcctgcccgctgtcctcccttccttggttccaggctgaaatctagaaggatgccaggtggggccagcaatcctcctgcacacggttttgaccctcctatccccccaagtaggattgtgtttgttccctgacagagattctccctgaatcgggggttgtggcggggagtgggaaggggagtcccaggcctgggtggtgggaaatgcgggggtgggtggctagcgcggccgactctccctcagtcagctgcccgcagggaacgtattaccacggccagacggagcagtgtgtgccatgcccagcgggcaccttccaggagagagaagggcagctctcctgcgacctttgccctgggagtgatgcccacgggcctcttggagccaccaacgtcaccacgtgtgcaggtgccaggggaacaaacaatacagagtggggtagggtgggcactgggatgcccatgggcatgggatttcccaaagggcaggcccaggctccaggccactctcttagtcaacatcctgtttgtatacctttgtcccctgagatcgggtgaccccatggggatgactcaggaccatccccatcagagttgggcccttgattcattgcaggtcagtgcccacctggccaacactctgtagatgggttcaagccctgtcagccatgcccacgtggcacctaccaacctgaagcaggacggaccctatgcttcccttgtggtgggggcctcaccaccaagcatgaaggggccatttccttccaagactgtgacaccaaaggtgagtaagctactcacctccctgggggatgccccaaccccaactactcccaaaaaactctccaatttcccagaggggacactgacccaccattttctccaaaccagtaatgggcccagctacttgaccaaccataccatcctgcttccaggacccaccctgcccctccactagtcccaagcttgggaactgagaaataattaacagtcccacttacccctccactttggagaactggtggcatattctcctccatatcccaaatgagtttctatataggtttggcactgtgctcagcgtctgaaagaaaaggattggcactgtagccaaccactctgtaaactctgtttttccgtgggcttaaattctggcatgactgggaaagattgagaccctagaaaagaactttgatgtatctgatctcctgattctccaggatgaatgtatcctgtccatcccatgccccgtaactcccacctgcctaccatcttgattcctgcccttctcccttgcctacagtccagtgctccccagggcactactacaacaccagcatccaccgctgtattcgctgtgccatgggctcctatcagcccgacttccgtcagaacttctgcagccgctgtccaggaaacacaagcacagactttgatggctctaccagtgtggcccaatgcaagagtacgtggcaagccaggctgtgcaaaagggaggagagaggcctgggagcagtggacatctaaaggaggggtgtgaaaccaacagggagcagggctggggggtggaggagcaggaaaactccaccttccacctctccccaactcactcaatctcaaggccagttgctaggctggaccctgtaacaccctctccctggagacagttaatgaggaagcagagacaggtgaagtgagaagagaaggtactaaaagggcaggaaggaagatggactcagagcttggaaaataatgatgaactagaacgcagacttcccataaatgtctgacctctacttcagaactcttcaattcccccagcacacttccccactgacttcccttctctgtcttgttttatccactggggtttggctgcagatcgtcagtgtggtggggagctgggtgagttcactggctatattgagtcccccaactacccgggcaactacccagctggtgtggagtgcatctggaacatcaaccccccacccaagcgcaagatccttatcgtggtaccagagatcttcctgccatctgaggatgagtgtggggacgtcctcgtcatgagaaagaactgtgggtggcttgcagagctgggccagggaagggcagtccaaatctggttaaggcggagaacaaagagagagactgatacaggaagaaatggggcagtgaagttagggatctatgagggtgaaatagtgagaggcctttaggaagagagaagctaacaaaggaaaacagcaatgacacatgtttggtagaaaacagagttaagaaagctagcagtggggctagaactccaatggcgttacatgtatcactttcctatcctagcatttttgccattccattcatttaaatgtcatatttattacactatgtgagtgcccaggtatcaaggaggaattgtggaatgagcccagtgggcaatgggagagggtgtggggtagggtgtgtgtatgcgaagggggagcctttgtcagaatgattctcttgccctatacccccaccaccagctgtacagcccacgttctaggagggcttgggtagcctgccctgctgctctactgacctgctgcttgccttcccagcatccccatcctccattaccacttatgagacctgccagacctacgagcgtcccattgccttcactgcccgttccaggaagctctggatcaacttcaagacaagcgaggccaacagcgcccgtggcttccagattccctatgttacctatgatggtaagccaaggaggtgggtgagaaggggaggtatgtcagttttgagagggaaccaggagagcaggaagagctcccgcccctgagcccctcaccttggttgactttgcagaggactatgagcagctggtagaagacattgtgcgagatggccggctctatgcctctgaaaaccaccaggagattttaaaggtgaatgaatattaacaataatgatagctaacatttaataagcatgtaacaatatataggcaataggctaagtgcttacatgaatattctcacttgatagacacaatagctctatgaggtaggtgctttctccattgcttctttacagatgggaaaactggggtatagagagttaaagaacctgccccatgggaagctgggatttgagcccaagcctatccgactgcagcgtcacccacactatattacaccttggggaaaacttggaagagaaagggaaagtgaggagaagaaatgtccctacctcttccaagagacatagggaaagtgaagtatagaaagatacttttgcataagtcccttccttcccctattctctccccaggcctcattaagcagcagcagataggctgcgtgtggtggttcacgcctgtcatcccagcactttgggaggccgaggcgggtggatcacatgaggtcaggagtttgagaccagcctggccaacatggtgaaacctcgtcttaattttgtaaaaatacaaaattatccgggtgcggtggcaggcgcctgtaatcccagctactcaggaggctgaggcaggagaattgcttgaactcaggaggcgcaggttgcagtgagccgagatggcgccatcgcactccagcctgggtgacaagagtgaaccctgtctcaaaaaaacaaaaacaaaaaaagcagcggcagatctagcacagctttctcagaatcaatttatgtacagacttcttttcaaggaaaataaatacttccaacatggaagaatggactagatgccctgggtcggtgaatcccaatttaagaaaatcttccttaagaaactatagtctggctgcgcatggtggatcatgcctgtaatcccagcactttggggggctgaggcgggtggatcgcctgaggtcaggagttccagaccagcctggccaacatagtgaaaccccgtctttactaaaaaaatacaaaaaattagctgggtgtggtggcgggcgcctgcaatcccagctactcgggaccctgaggcaggagaattgcttggaccggggaggcagaggttgcagtgagctgatatcatgccattgcactccagcctgggcaacaagagttagactcagtctcaaaaaaaaaaaaaaaaggaaactatagtcgtagtcatagaattatccttcataaattatcactgcaaaaaagttaagtgttagcaaaatatttttatattatcatcaaaataaaagccttgacaacaaaaatcacctagaacttgcagacttcaaagaatatacttttaataatacttttcaaacatttttaaagcatctgaacccttatttcaaatcaaatgtactgtggaattccaacacataaagcagtgcagctgttctgattaaagtggggtaagaggctgaaacccctacttcttatttgaaaaatccactgacgccatggaaggagcaccagcctaggagccagaagacctgagttttaatgcacagtgcctggcacctagtaggctctccacataccatgctactgttgtagacagggtggtcaggaaaggcctctaaggagaagagacccaaatgaggtaaaagggctccccattagaagatgagggaggagcattccaagctaaggagcatgggagcaatttagtgtgttcaggaacctccagaaggccagtgtggctcagcagagggagcaagagtggaggtggaaagcaagatacagatcacattctgccaatgagtgataaaagaaaccagagaagagtttcaaacaggaaaaagatgaactaattaaaaacacaaaaagtcactctggctgctgtggggagaagagtctacggagggacaaaggtagcatggagaccagttaggaggctactacagtactccaagtcagagacagtggtggcttgggaagatgataagtggtcagacccagacatattttgaaggtagagtcaataggatttgctatacttgtaagcaagaaagaggattcaaggatggctccaaggattggggcctaagcaacagaaggatggagctgccactgattcagttgtggaattccagaataagggcagatggtgggaatgggaatccagagttgccctctggatatattcagtataggatgcctagtagacatcaagaagggctgctgagtcatggtgtttctctttcccacccccgacggtgaggctgacattgctccctgccatcctttgcaggacaagaagctcatcaaggccttctttgaggtgctagcccacccccagaactacttcaagtacacagagaaacacaaggagatgctgccaaaatccttcatcaagctgctccgctccaaagtttccagcttcctgaggccctacaaatagtaaccctaggctcagagacccaattttttaagcccccagactccttagccctcagagccggcagccccctaccctcagacaaggaactctctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaagaaaacagaaagaaaaaatgtatcatctaaaggactagacacagaacaattggaagtcaacttcaaacactaatcccttttcttgtcttccctggcccagccacctcctcagccccatgtgatgctccctgggggagccctactccccttgctacatgttgtccttaaacatggttattgacctgaagccagcctaggccttgccctacagttgtttttcccttgtagccccagctggcttgtgggcttcaccaaagaggaccccactctgaagccagcctggagccacctacctctggcctcaggctgtgggcagcaaaaggaatgtgtgtgcacttggcgagcctcctgcccaccctgtccacacctaataagtgcaatcattttgagtctttctatgttgtctagacggaggggtttttgttttctgggtttgttttttgtttttgtttcttcttcctctattagcaaaaccctatttatagctgcccaagagaaaagagtgtatgtttggagtggaagaaaatcggttttgaatctcatgaaccttgagtgctggagcatctgatctgtctctatgccaccactggccacctagagcccttggctgtggtaatccagggtaattgcgcagaggcatctgatgtgtaggaaagtaattctggggatttgatggagcagaaaggagagagacctatgtttgctaaaccaatcttgctatccctatgcctctccatggagtcagtgtggacctcatgattatagaggccaatggaactggtcagtgattctctaccccaagtagggaaaacctccatcttttccctgtcttcatcctgttatcccctggtgtacacatggaagaggaccaggacataccacctggggatgggctgactcagggtcccgaggccagagacaaagctgtgggagccaagaataagacagaaggcatcagatatttgcctggctctggtcacttccctttgaagttgacttcaagcttagcttcctcaactactgtttttcagaaggaagaaagaatcaaatggaagaagaatcaagtccatgcccaagcccaaagcctgcacacattctgcccttaatccaagtgttgcctataaaattattttctgttttctcactctagttcccccaaagctgtagtcccaatcaatcaaaggctaccaactgagtcctcaggttcatttcttttttttttttttttctttttaactctcctggtaactcacagaacagctcaggttcatttctaggtgactgtcctaggctactgctcccccaggagactcaacactaaataaaggagtctgactccctgccctcccatcagtagcattcatcagccaaaacggccatagcagtaggtagccaatgacacagctagattccctgacaaccattagccaacatcatggtccttgtgggtagagtgtctggctacctttgtctttctgggtcaaggagggccactgtaaagatgcaaaatggctgcttccaaacaagggaaatggtcatttagtatgagtgtctctgtacttcccaggaagcaccatgaaaactgctttaatcaactctgactatcctaattctccaccagaagctaggataactttctttctttctttctttttttttttttttttttttgagatggagtctcgctctgtcacccaggctggagtgtaatggtgctatctcggcctactgcaacctccgcctcccaggctcaagcaattctgcctcggcctcccaagtagctgggattacaggcatgcgccaccgcgcccagctaatttttgtatttttagtagagatggggtttcaccatgttgcccgggctggtcttgaactcttgacctcaggtgatccacccgcctcagtctcccaaagtgctgggattacaggcatgagccaccgcgcccagcctaggataactttctgattcctctctgccagccgttttgcgtctcttggaaagccaaacggtgaccatgcttcttaatttatgccttcagggtctggcttctcctttctcccttcctttcctgtcacaccatgcatacatacatacaaatacacatccttcaaccatttattccatggcttatgagacctgcaaatgagttccacagtacggaaggcatagaccactaggcttcttaattgatgtcaaggcagatcttggtgagcaggtaaaaacctgctattgtccaccaagtttaatttaggtcctccaagttggagggttaagaacccaggcaaagctgctgctgaatctatggaggaggctggccctgggacatcaaactaggggttaactggattgaatgaggagtcaacgctcagggacattctaggtctttacaggtcagacagaagagaggtttttaccattggagggaaatggaaagatggtataaataggatcccttcatgaagcaacccagaggcctctctgcagcgtgtagggtgtggggcgacagtattgtggggcttccattcatcttagtacaaaacctcacctgctctgagcctggaaatgggagggcttcacgcaccaagtaatgcacaccagaaaggcacttatatcctcagcaacatggcagttcctctttacttctctgcctccctctttctatattatcaggccatgcctattcctacaacctgagacaactcttggagtcagaagaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggaatagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatattgtatttatatctgccttccactgctgccaatttagtaagcatctcctatacaatcgacaataaacagcaaatgatgcagttcatagagtattttgcacttggggaaaaatatgtatctgaattgtaaaaagaaatgtttggattttgtatgtcttttttattattattaaaatactaaatgaaactcctcagcccggcatcttttcctctatctcaatagcttatcccagagccagaaaaagccttgaggagacaatgtcttctggcttccagataaaacttaacccaaattttttggcaactcatccctaatgattttaaaatttgaaaaggcttgtcttttctctgtccttaaaagcagcatcaagtattatctcctgagggggatctaaggagtgggggaaatttattgttcctcctctccacagtacagtccacaacagctggccagcccacaggtggttcagcacctccctactcaggatgtcccacctctaggaaagcgccagcactgagggtcacccagtgtcattctttgtatgcagtacactcttagccaccaaatagtattgtgaaatacagatcatttagtcactaccaccatcactactcctacagggcaggagaaagcaatctccaatctctattataaatgaacagtcccaatttctaggctcagagatatagataaaactttgctgttgcaattatataattccctttcatgaaattttattggatttaatatctacatgatatagccatttaagagtataacttgagcaacaaggaaaaatctacctgatcaaaaaacatgtggggtggcctatcagaatcttaaacttaccctttagcatctataatgaagatacagatgaagtacattcattccataattactgagatcctattatatgccaggtagtgagcacctgctcatcagcttattgacaatagccatgctcaagatccacactcctcatgtaactttctgattataattgatcttcccagataagatttacccaacaggagcgataatccagttcacttggtggctgtaagtataaaagaatgcactggcattctattatgtacattaacttcctatgagtttgatttaatgtgacaaaacatgaacacctttgtgtggactgacccaaaatcacacttctagaactgcaaagccaaggaccatatccatgaccttcacactataccaacttggagccatcctctttgacttctctcataactcacttctattctaagaacaacacgtcttcctccttacttcgtaggacatttgctttggtgtctcaaaataatggatagtcagggacattggagtttggatatgcctatattaagaagtcttccaagtggggtaaatgaagatttttcctagggtacgtaagactgcaaggaatacccaggaaatagcctcaaatcagtctgaggagagttttaaaggaataaatttccagatcctcaacttccctataaaatattttctaaaaccaggccgggtgcactggctcacacctgtaatcccagcactttgggaggctgtagcgggcggatcgcctgaggtaagagtttgagaccagcctggccaacatagtgaaaccccatttctactaaaaatacaaaaattaaccgggtgtggcagtgcacacctgtaattatagctacctgggaggctgaggcaggagaatctcttgaacccaggaaggggaggttgcagggagctgaattgggccactgcactccagcctgggtaacagagcaagactccatctcagaaaaaaaaaaaaacaaacagccgggcgtggtggcaggcacctgtaatcccagctacttggcaggctgaggcatgagaatcgcttgaacccaggaggcggaggtggcagtgagccgaggtcgtgccactgcactccagcctgggcaacaggagcaaaacttcatctcaaaaaacaaaaacaaaaacaaaaaaaacggccaggcacagtggctcatgcttgtaatccccgcactttgggaggccaagacaggcagatcacaaggtcaggagtttgagaccagcatgaccaacaaggtgaaaccccatctctactaaaaatacaaaaattagccgggcgtggtggcacgcgcctataatcccagctactcaggaggctgaggcaggagaatcgcttgaacccgggaggcagaggttacagtgagctgagatcatgccattgcactccagcctgggtgacagagcgaggctccgtctcaaaaaaaaaaaaaaaaaaaaattctaaaaaccaatccatttgggagccagctgacatattcatgcacattctccactctaccactgcccccactttcaccatagtccttgtcctactttacaaaagaaaggaatgtctctcccctacactgaatcttgatgcatggtccagggtgtaaaaacctgaggagcttggagggagcaattattttccacttcatatcaaaatattcccattgcaatcagtcttcctattttatcttatataaaatgtttattattttctacctcctagtaaaaagtgaaattgctagctgctcaattcattatttcttagcaaatacagctttcctttctaaaaaatacagaagaaaaaaatttgtgtaacaagattattagttatttctgatttttagacatgattctcatttaattgttcccaaaagctgaacaacaagagtttgatgaaagcaggcacacacatttaccaagggaatatatgccttctatatgacttctcaaaactgatggatttaactatacattatacagcattattcctaattatataatgaaaaacagtactatcttatttttaccatttattatgttaatagtaggtctaaataattttaatcttgactggtttatcagtggtccattttataagctatagttaatcatttatttcctaataatttttataatattcctcaaaatgaatgttaacatatttatttgaatggaagaataaagtcagacatgtttctaacagaaagtaggtctgatttggctgattggtttgaaatgaaaactggctttgccaattccacaaatggcagttgttttctatacagtgaatgagctgaatctgcatttcagtttaacaaaaagttcttgaagacatgtaataattaaagaattttaccaaaaaatattgtgtaggcaaagaagtatggaaatcaatatctgattaacaaagtgtctctgagtgtaaaggtcacagataattaataatcatgtttaataaaaccaaaactgagactctaataactaaatccttttggaagttcagtggtttctaatcctttgcttttaacaaaattaaaagaagactctatttgatagtattaatagatcactctgtgattgttggcatataatttagaagttcaaagactcaaagaatatcattgtaacaaatctcttcctttcccaattgtggaaacaaggtttctcaatactcatgtctataaaaataaaaaacaggtaaaggattgatgttgcaccttatctccttctaccattaggtaatattaatccatgaatacctgaactaattggggagaaacaccatatttctcattaacagatgcattttcaataaaaattgtactttttaggtttcacaagtcataaaaatgttaaaaatatttaggaaaatttagtatttagtaatatttagtaaaaaaaaaaagtttagtaagttatatactaatgattacaggaagtgaatggaattcaaagtataaggagaaagagaaccatataaaatttctgttgaagagcttgttcatatatttttaagtggatgatggtaggcattagatttttagggtacttggaatccaccggatacttttttttaatgtgagacagtctcactctgtagcccaggctagagtgcagtggcacgatctcagctcactgcaacctccgcctcccgagttcaagtgattctcctgcctcagcctcccgagtagctaggactacaggtacgcaccaccatgcccggctaatttttgtatttttagtagagacagggtttcaccatcttggccaggctggtctcgaactcctggcctcgggatccgcctgtctcagcctcccaaagtgctgggattacaagcatgagccactgtgcctgccctgccagatacattaagaatgatgtagaccaagtgtggtggctcatgcctgtaatctcagcactttgggaggccaaggcgggcggatcacgaggtcaggagatcgagaccatcctggctaacaccatgaaaccccgtttctactaaaaattagccaggcatggtggcgcatacctgtagtcccagctactcgggaggctgaggcaggagaattgcttgaacctggaaggggaagttgcagtgagctgagatttcgccactgcagcactccagcctggttgacagagcgagactccgtctcagaaaaaaagaatgatgtaagtcttagtttaagatgtcaaaatttgaaattgtatcctctataagtatttaaattaatgaaggaaaatttaggtatcaacttaaaaatgaacaagaggtacatagctcttcaaaattcttttatgggttcattctaaaaaatgtctgaagatcaccagcctatatgttgagtggaagggataggagagaaactgctagcaatggtcttcaatactgccctccaaaatatcctcaccaattctcctgagaacctgaaattaccttccattaggatcattacttcagattcagacactgtttcccagagctcttgttaaatgtataattgcagaggtgactggccatcagattacgatccgtaaggaatgtgagaaaagacagatatatatatacagagagagctatggaaaaagggtggttggagagggacaaactcaggtacagcctgagttctattccctgcggtatttctaaccctcaattcatattataagaggagctacttaatcttctctctgtatctataaggtactttttctttttctttttttttttctttttttgagacggagtcacactgttgcccgcgctggactgcaatggtgcgatcttggctcactgcaacctccgcctcccgggttcaagcaattctcctgcctcaacctccggagtagctgggattacaggcgcccgccaccacgcccagctaatttttttgtatttttagtagagagggggggtttcactatgttgaccaggctggtctcgaactcctgacctcgtgatccgcccgcctcagcctcccaaagtgctgggattacaggcgtttaagccacggcgcccggcctataagttattttctatgggaaataacttgtcaaacttccaccaaaaaggaatggaaagagggcagcatagtggccaggcagtttatttccatactaggagatacagaagggattaattctaaccgtaggaattctaaccatcaaatgtcactcactggcctacctaaactgaactctggtcccagccagaacaagtcaggaagaggggatgtctaagaccgaaaggggggctttctagttaagctcttcaggcaggagaggaaaaggatgcccgcatccccaaagacacctttagctaccacaagccccaaaccccgtactttgtaactgtgtctagtttacgtcctttaaaaattattcttattaagttaaattgttttcggggcggggaagatacaaaagaaaccagttaaagtctgaaaggatagagaggggaaagtttctcacctcattcttccagccacccagttcctctcctaaaaggcaatctttaccagttccttctctaacgcccctcctttttaatttgattttttaccgaaagctcgctcccttttaattttccctcaggtttctgaaaatttcccaatcgcagcccctcccagcagggaaatagtaaaggggcttggtttttatgttcaacccaaagcaagcctacaaaagggagtagtcggtttcgagcctgacggtggagctgacgcgggaatgagagagaacctgagaagaccgccagggcgccctccctgcggaggcgagtccctcaccgcccctctacatcgtccttttcaataaggagctcttaatacctgcaactgcttccttcaaggggtggctggaagatcagtaggcaaggcctgcggactgcgcaccttaaagcgcttcgggaccgtaagacagtgagtgctgagcgcgcggccgggaagaagcctggaggctctgagctcggaggacagagaccgaagccccagggcctgcgtccctcacaacctgcgcctcctgtcctcccgcgctactcccgaagcgcaccttctcgcccgcaggccgcagaagtgatgacgcaaagccctcggggcctccgccacctcctcacgcttctgctggaccgaatccttggaatggacaggtagcggttcccgattgctatagcgacgacccggctccgagccgcgcccaggccctgacccgggcgtcgtgacgtcagcacgccttccctgggcgctcagcctcgctggccatgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgaggcaagctgcgcgcgggcgggcgggctatggcgcaggcgggttgtggggccggcgctggtggcggggcccggtgcatggcggtctgtcggcggagtcgccctcgggggctgtcaggttggtggctgcgggaggagtgggccaaccatgcccagggcgggaggccgggcgggcgcaggaccccgggaaggtcccgagcccggcgtgcccacctccctccggccctagcagggcggcctggccgctggaccgcggccgggccccctcccccacccagggtccctgcccctcttttccgccttgcggctcctcccccgtgactcccaaacctcaccccgtgacggcgcccgcctccacccttgtgaccccacaccccacccactgaccccaagacctcaccaggtaaccgttggttattattcattggctgctaacccaggaatttccccagcacttctcagagacccaccaaccagtgactccctcagttttaatccggtgactcacatgaccctgagatccccacactcctccttagtgacccccaaacctgggtaaccctcctggcccagtaacccccccgattctaccttgtgttccccacaaactcggtgactcccctcaaaactctgctggcgactcctaagccctactccaatagttttccacgcactcaccttgtacacaaccctcagtatctttatcctgtagccgtatgaccctcgttccacgtctgcctttatcctaaaatcacccccactggcatctctctctgcgatcccagcccttcagtgtcaatcagcacatgacttacaagcgtccagcacctttctggtgctaaggaggatatagagattaatatgaagtagtaataattggaggcatcagagaattctggatcaatccagaatccagtcaatccagtgtgtggtcccagctctgtcactgctgtgctttagggacctgtgagaagtcccctcctcagtctggacctcagtttctcatcatgactgtgatgaggttgggttagatgatctttgagtttccttccgtctgtgaaattgtgaaattatgcagttctcagtcaagataataattttttgcaatcatttttgtaccccaccctggaaatttcctcttgtaacctcatcccaggatctgcttgcatcatgaaccttactccctcattcccggatcaccctcttcactcttcatagtgcatacccatttcccttgatcaggccccatcagttaacatgtttgcaaagcagtatagcagagtgcttcatttgggggcattgagttcataacaaacctaggttccagactgattctggcccttcagctatgggacttttggtatattatttagcctgtcttaacttcagtctccacctctgcgaagggagaaaatagtagtgcctgacataacatatgtaaagcaccgggcaccatgcctggctcatgggaacccttagcataagctgttgttagaaatgagaagctgctatggatcttactctgtcctgagtgctagggatttaacagactgaacatgtggcccataccttgcattatgttgctactactgacatcttggaatccctatcttctcatctctgctgtagcctcacttctctggttcttaccctgattttgcctcaataacgattggcttgctgaatacctactgtgtgccaagctctggatatataagttaaatttacgtctcaacagccccaagagttaattattattatatccaccattttcccttcccatatttttgtttggttggttggttggtttcagagaaatgaaccagaaactctcacagctaagtagcagagctaagatttgaacccacagtttaaaaaaacaaaacaaaaccctactccattgcctgtctttcccccagacttactcaacctcagctccttattccttattttctagtaattcctaaatacaacatcagctcgttccttgatccctaaggtttctgttcttgagctcctagcctcaagagatcctcccaccttagcctctcaagtagttgagattataggcgtgagccaccaagactggccctgacccccaaggtttctattaccgtttgccatgtaacttggtgactttctcatcctgctgttcatgacttttgatctcatatcccctgaagcccctgcaccttgtaggggagggaaaatatcttcttaggttcatggcttaggcccctataacaacagatttaataagagaagattatatacatttatttaatgtaagttttatgtgacaggagccttcataaggaaatgaagacctaaagaaatgattaaacttgtatatttttatactagatctgatgaagagtggatagttgtggaaaaatacaaaaagggtaatatcaaatagtaataaactgggagaaacttagcaaggcctgtttgttcagactcttctctgtgtccctgtgtcttcacagataagggtgcttctttcctctgagtatagggagggcacctctttatgaggagggtattatgacctgcttcaggggaaagtcagaaaaatccttcctaggttttgtgatctgcttcaggggagaagagcctcagagaaagtgagagtgaccttcctactgccattttctcaagttgccatattttggagtagtgtcttgaacccagtcaacttctctcttcatcctttgcccaaatatctcttgttctatgaatctttgacgcttccagccctttccctgtgaactcactcaccatacagtgtctcccacctcactggcactttaccccaaatcctttcatcttgttaagtcccttagccccaggaatccacaagtctgtatgctctaaaaccatctagcccagttgcctttcatcctattttttagtctcagtgttctactcccaccaccccaccttctgccatcctcagccacattctgtgacctgaaaccttcatataatttgtccttcatttagtgacctcttgatgtgactagcttcaatggaatcggctccttccatcccagcatgaagcaatcctgtataacttgcacaccctcccattctaaggcctctcctctcatacccttgcccagtatcctgtgagatcctgcctctcagattcctccctcaccttttcaaacccggattgtctttcacccttccacagggcctcctcttcctgccttcctcttatttgtcccctcagccatcctcacctcaccaatcttgataattgattacaatataaatctcccttccatctcaggtctgctcctttcttcctccactctcttgtgcatctatctccagggccatgcgtatgcccctgctgctttcagctctgcttccttcatatgctgcactgttccaccaaacttcatcagtctcttcggtttatccagagaactacactcttctctgggaacttctgatgacttctgataatagatcaccaaaggatcttggttttttagagggcagggagagagccctttgaagtccttcagaatcaatctagctgtgtctcctggacaccctcccactatcctatcctgttatgaagctgcttgctgtatatgccctcagagtagaatgctttgggtgtcagcttctgcaggcactgaattagccccattgttttccaagccctgggaaaacttgataatccccaaccactgaagtctgaagagtcagtagcaaaatgtgacatcaaagatccacatccaaaagtctattctgtgggtcaccaaattcccaggtctcttataatgtacttattggctgtgcagcaataaatacagcagaaactaaaactagagttgaggaaagggtataccctgggttctacaactgctgtgggtggattttaaaaaggagttcttgccttagatttgtttacttagggcacagaacttattctgccttgtatttgagttatttgtgtacttttctcaaccccactctgtgagctctgtgagaacagagactaggttttcttttttcttttcttttcgagatggagtcttactctgtcacccaggctggagtgcagtggtgcagtcttggctcactgcaacctcctcctcctgagttcaagtgattctcacacctcagcctcccaagtagctggtgttacaggcgcctgcaaccatgcccagctaatttttgtatttttagtagagacagggtttcaccatgttggccagactgatctctaactcctgacctcaggtgatccactcgcctcagcctcccaaagtgctaggattacaggcatgagccactgcacctggctggttttctttatcttctgtcttcatctcttccctcacatttagcaggtagtcagtacttacctgttggattaaattaactcactcagaaattctgcatcaggtgtacaaaagtaaaagcagttcatgtctacattcattttgtggacacaacacccctccccaaagttctccaaacatgataatgggcatgtcccttgatttaaacgtcggtaatttagacacttccttttttagtcattgctcgggtgggggaatgggtgtaagtgcttttctttttctactgtatttctggtaagataggttgtttgacgcagttgctcaaatacagtggtaacagcatcaggggctgtcttatataaatctgttctcaagaaaacagctagtttgaaatatttagtgtgggttgcagagacgattaaggaacagaggaaaccaaggaggcaaaatgttggtaatttttgaagttggataatgggttcaagaggttcattataccattctttccatttttgtgtatgttggaaatccattataaaaagattaaaggcaggggcagctaggtgaacaagtgcaaatttagcactgttccttggaaaacacctcagagcaaatgagctactgtttctgaatcagtactgttatctaggttaagtagtatatttagtcctaacctttctctgacctcttctgtttgtgagatatcaggatgctaaatttaaaaattagcaccctgcagaattctgtacctagtggcctgggaattgtaacatcctggcatcaagcacctgttgcactgcttctcagcttaggtatggtttctggtggaatagggctggactggacctgagaagagggtgaggcagtaaggaggaaagagggactgagggctggagagagaccagagctctactagggtcttccccttcttgcctaaaggtttcaagttactgggagatcctaaaggtatatatattcattcattcactgattcattcatcccacaaatatttggtgaatatctgctgtgtgccaggtacttttctaggtactgggaatagagcagtgagctcactgtttgaggaatggacagggtagagacagacaataaacaaataagtaaaatatatattgagaaaattaagcagagaagggagatagaaagtgccaggagtaggccaggtgcagtggcacacacctgtaatcccagcactttgggaggctgggttgggtagataacatgaggccaggagtttgagaccagcctggccaacatggcgaaaccccagctctactaaaaatacaaaaattagccaggcgtggtggcaggcacctgtaatcccagctactcgggaggctgaggcacgagaatcacttcaacccaggaggcagaggttgcagtgagctgagatcacgctgctgcactccagcctgggcgacagagcgagactctgtctcaaaaaaaaaaaaaaaagaagaagaagaagaagaaaatgccaggattctgggtgttaaaattttaaatagggtagttgaagaggttcccactaaaaaggtaacatttgagcaaagacctgaaggaagttagggggtaagtcaagcatacatctaggggaaatttattccagtcaggaagaacagcaaacacaaaggccctgaggcaggaatgtgccctatatattcaagaaacatgaggaagccagccaatacggctgcagtatattagtgagagaagaaatggcagatgttgcggtgggggtgaattgggggcagatcacacaggccactggcttgtagtgtgagttgtgagtgagatggtagccattagagaattctaggcagataaataacatggcctgacatattgaaaaggtcattgtggctgctgtgttgagaataagctataacggggcaaaaatggaaggagagaaactggttaggaggctactacaatagtctaaacaagagaagttggtggcttgaacccaaggtgaagcaatggaaaggtgagaagtggttggcttctggatgtatttggaaaggagccaacaggatttgctgatggactggatgtgatatataaaagaaatagcagttgagggtggctacaatttttttttttttcaagacatctcgctctgtcgcccacggtggagtgcagtggcgtgatctcagctcactgcaacctccgcctcctgggttcaagtgattcttctgcctcagcctcctgagtagctgggactacaggtgcatgccagcgcacccggctaatttttgtatttttagtagagatggggtttcaccatatttgccaggctggtctcaaactcctgaactcgtgatctgcctggctcccacatttttggcctaagtaacaaaatggtaaaattcccatctactgaaattggggagcctggaaggagggcaggttgttagaaggaggagataaggaattcactcttgaacatgtcaagttcgaagtgttttttggatatcaaagtcgagatgttgagtaagcagctggatattcaagtcttttggagcctaggaaatgtctactctcaggaaataaaagaacaccatcacctggcaagagacagcggagtatgggaagaacactggtggtcaggtgttaggccctgctctgccaccaggtagctatgtgatcctttgggactcctctggcaacgcaggcctctgtctcttcatctgcaaaatgactgctttattttattttattgtctatttcttttttttttttttttttttttgagacggagtctcgctcgtcacccaggctgaagtgcagtggcgccatctcggctcactgcaagctctgcctcccgggttcacgccattctcctgcctcagcctcctgagtagctgggactacaggtgcccaccaccgcgcccggctaatttttgtatttttagtagagacggggtttcaccgtgttaaccaggatggtctctatctcctgactttgtgatccgcccgccttggcctcccaaagtgctgggattacaggcttgagccactgcatccggccccttatctgtttctttgacaaggtcttgttctgtcacccaggctggagtgcagtggcgcaatcatggaggctcactgcagcagtgacctctccagctcaatcagtcctcccatgtcagcctcctgagtagctgggactacagagatgggcaccaccacgcctagctaatttttgtatttttggtagagagggtttcaccatgctgcccaggctggtcctgaactcctgggctcaagcctccacctgcctcggtctcccaaggtgctgggattacaggcatgagtcaccacacccagccaaaatgaccactttagactaggaatgagttgtgttctcagcccctcctattgtgggagttgatgaattaagtgcttagaataaacatgataatatatgtgtatctgagagcattttggaaactgctgagttctacaccaggtagtggtattggcaataagatttcttccttcattcgctgaagtaatacccagtgagtgcctgccatgtggtgggcactatgtcacatgaggatacgatgatggagaagacgaatctgtgccctcagggagcaccgcagacaaccccctgttgtggcttcactgccaagtgcagacgaaacatggggctggagtgtgacattagccagggaaagcttgttcctgatctgggtctccgtggaaacagtgaacgtgcatgtcaaagatgaggcaagatggtaatcccgatgagggaaaagtcatccacttagctggactagggaagagttgggagtggttgggaagggttggagtggtgggggcttcagttccttccctcctccattctttcgttcaacatttacttccttgccaggagcttctcttagaagctcacagttctgtggtagatgaagagtttcatatctggtctcaggagttcaacttagatattacaataagcagaactgaatcaggattcaaatctgagctaaagagctcagttagctatgtaacctagtagtattaatcatttggtatctgtgggcacattctttgttaggtgctaattaggctgaaaggcatgctctccaggaacttaaattataatcactgtaacagaaagtaagaatgttattttcccctaaaagagtcaggtgttaaggaaaacacactccgtggcagtgtaaccctttaactgcatctggaaactgtccctgtggctgtgtttattcttgtgtcatttagatgtctacgtttatatcgtgaggagagtctctttgaccagataagagtataagatatagctcatcctaattgacaaaattagtcacccacaaaattagtttagaggagacatagtcaacatctaccacgtaatggaatggggaaattttgtcctggagagtgaaaaaagaaaaaacaaacaaacaaaaaaaacgaaacctggccgggtgtagtggctcacacctgtaatccgcactttgggaggctgagatgggcagatcacgaagtcaggaattcaagaccagcctggccaacatggtgaaaccccatctctactaaaaatacaaaaattagctgggcatggtggcgtgcaggagaattgcttgaaccaggacccaggaggcggaggttgcagtgagccaagatcgcaccattgctctccagcctgggctatagaacaagacttcatctcaaaaagagagaaaaaaaaaaaaaaaaccacctgcaatacaaatccaagtgcagctgaagccattgtctttaacagatggccctaacctgttttgagtgctgtttcctaaagctgccaacaaacttcaaatgccttttaccctggcagctatcagtcaagatatagaaatgtgatggtctcacaaatcctatgcaattgtctcttttgctggcaaaagtatgaggccagccgggtgtggtggctcatgtctgtaatcccagcactttgggaggctgaggcgggtggttcacctgaggtcaggagttcgagaccagcttggcaaacatggtaaaaccccatctctactaaaaatacaaaaatttgccgggcatggtggcaggcgcctgtagtcccagccactggggaggctgaggcaggaaaatagcttgaacctgggaggcggaggttgtggtgagctaagatcatgccattgcactccagcctgggcgacagagcgagactctgtctcaaaaaaaaaaaaaaaaaaaaaaatgtatgaggcgtactcaggctcctctcttccagttcagaatcagaaggatttgtgatgttggacaggtcattcggggtctcaggctcattatactgtcattacctggaagccagagtgcctcttttctagtgcctctatttgacattcccttagagctggccctctggtgaatagttcatccctaagaaggccagatacaacttgttaccctggtactatctcacttcatcacttcatttgttgggagttcctgctacttttggatggttgataaagcatgagacccatacagttaagataagaaccaaggaactgggagctctttgaggttgtagaactgacttgaggctttgatgttggggatttggcaggggtgcctaagaccagagttctttctctgagatcatcttctcaacccaggaaatactgtcctgtggccacatggagcaatgaaggggaaaggtagaccctgcttaggccaccacttcgtccagacccacccttgtgaccaggctggggacacacatgttgaagccaccatgtcctcaggtcctgtatagacttgctgttgcctcatgctcagctgatcagctttccatatgatgttatagaatggcctccatgaatcacgaagctcagttttcggatgtgcttttgctgtagatcagtaacatggaatccatcatatcaacactggactctccattcctcatgtatggagaatcatagatattcctgtaaccaacaaagggagtacaaagcatgcatttagactttctatttttaattttttatttatgttgcgtaggtaacacattctcaaggctttttttatttttatttttttattgagaccaagtcttgctctgtcgcccaagctggaatgcagtggtgcaatcttggctcacagcaacctctgcctcctgggttcaagtgattctccagcctcagcctcccaagtagctgggcctacaggcacgtgccaccatgcccagctaatttttgtatttttagtagagatggggtttcactatgttggccaggctggtctcaaactcctgaccttgtgatccgcccgccttggcctcccaaagtactgattataggcatgagccactgcacccagccatttgtttttcgtggagtataaaagatattccctgaaaagtcgcccttccatcgtcatcaccactcagtcatccttccacaggcaaccctggttagtaattttaataatttcttgactatccttccacagattttgtttgtttgtttgagatggagtctcgccctgtcaccaggctggagtgcagtggcgcaatctcggctcactgcagccacctcctggattcaagcgattctcttgcctctgcctcccgagtagctgggactacaggtgtgtgccaccatgcccagctaattttttgtatttttagtagagatggggtttcaccatgttggccaggatggtctagatctcttgacctggtgatccgactgcttcagcctcccaaagtgctgggattacaggtgtgagccactgcgcccagcccacagattttttaatgccaatgacattacataaaaagcactgttgaacccgggaggcagaggttgcagtgagccaagatcacaccactgcactcctgcctaggcgacagagcaagacttcgtctcataaataaataaatggcactgttttatacctagccatttttttcattatgttttggagatcttgccatgtcaatatgtaaggagcttcctcatttatgtctacgtagtatggaagtttgatattgatggacatttatgctgtttctaagtttttgcttttattacatgcagagatgccatagataaccttggacatgtgccattttcacgcatgtccatctacctgtagactagatgtgaaattgctgggtcagataatatgtacatttgtaattttggttgctattgtcaaactctcctccatagagattttgccaatatgttctcccaccaccagcaatgtatgactgtgcctgtttctccacagcctcatggacattgctttgagttaagaatatagcagattctgctgcacagtggctcacgcctgtaatcccaatactttgggaggccaaggcgggcagatcacctgaggtcaggagttagagatcagcctggccagtatggccaaaccccgtctctactaaaaatacaaaaaatttcccgggggtgatggctcgtgtctgtagtctcagctacttgggaggctgaggcaggagaatcacttgaaccctggaggtggaggttgcagtgagctgagattgcaccactgcactccagcctgggcgacagagcgagactccgtctcaaaaaaaaaaaaaaagaaaaaaaaatatatatagcagattccctgaagatcaacataggatactgaatcatggggtcccactgtgacactattccacaagacaaacaaaacacggcacatcccagtttgaagaatacagccaggcacagtggctgatgcctataattctagcactttgttgaggctaaggtgggaggatcacttgatcctgggagatcaagaccagcctgggcaacataataagacctcatctctacaaaaatttaaaaatttaaaaaaagaaaaattagctgggcatggtggcacgcacctgtagttccacctactcgggaggctgaggtgggaggatcgtttgagcccaggagatcaaggctgcagtgggctatgatcatgccactgcactccagcctggacagcagagcgagaccctttctcaaagcaacaacaacaacaaaaacagtttgaagactactgcattaaaaatatatccaccaggcaaggtggctcatacttgttaatctcagcactttgggaggctgaggtgagatgatcacttgaggccaggagttcaagaccagcctgggcaacatagcaagaccccatctctacaaaaataagtaaatagagatagatgtaagtaaataaataaattagccaggcttggtagtgcacacctgtagtcccagatatttgagagtctcaggcaagaagattactttagtctaggagttcaaggttgcagtgagctatgatcatgccgttgcacttgtagtgtgggtgacagagcaagaccctgtttctgtgtgtgtgtgtgtgtgtgtgtgtgtgtgtgtgtgtgtgtgtatgtatatgcacatatatatatccaagaggtagttggacttctggtagttaaaggaagaaaacttcttaaggcagttctccaccttggtgtttatgccagcatgaattagaaaagaagtagattgatgtttttcattttcttttgagacagggtcttgctttgtcacacaggttgaagtgcagtggcacaatcatggctctccaaagcctcaacttcctgggcttgaatgttcctcccacttcagcccccgagtagctgggaccacagccatgtgccaccatgcctggcaattatttttgtagagacggtgtctgcacctgacctcagcctcacattgatttttttaagacggtgtctcggctgggcatggtggctcatgcctgtaatcccagcactttgggaggctaaggtaggtggatcacttgaggtcaggcgttcgagaccagccaggccaacatggcgaaaccctgtctgtactaaaaatacaaaaacattagccgggcctggtggcgcgcacctgtaatcccagctactctggaggctggggcaggagaatcgcttgaacccaggaagtggaggttgcaatgagctgagctcgcaccactgcactctagcctgggcaacagagtgagactctgtctcagaaaaaaaacaaaaaacaaaaaacaaaaaaaaaacgagtctcactctgttgcccagtgaactctggagtgcagtggtgtgatctcagctcactgccacctccacctcccaggttcaagcgattatcttgcctcagcctcctgagtagctgggattgcaggcgtgcaccaccacacctggctaattttcgtatttttagtagagatggggtttcgccatgttggccagggtgatctcgaactcctgacctctaatgatctgcctgcctcagcctcccagtgtgctggggttataggcgtgagccactgcacctggccagacattgatttttaaagcccaagtcagggccaggcacaatggctcacacctataatcccagtacattgggaggccaacgcaggcagatcatgaggtcaggagttcaagaccagcctgactaacatggtgaaaccccatctctactaaaaatacaaaaatcagatgggcatggtggtgcatgcctgtaatcccagctactcaggaggctgaggcaggagaattgcttgaacccgggagactccatctcacaaaaaaaaaaaaaaaagaaatgggggtctcactatgttgcccaggctggtctcaaactcctgggctcaagggatcctcccacctcagcctcccaaagtgctgggatttcttttaaatggcgcttcttcttttaaaaagaagaaaaaaaaaattgaagaaaaaaagcaatatgctttatgcaaagatgtgttttagctgtttaaaacttatgttagtgcaagtttgtgttactaatttcctgttttctcttcagtgtttagaaacccacagaaccaggcctgttcactaggtttttctgcgtgtagtgaagtatttttctataataaacattgaatcattttactgcaacttttccaaatctggttctgatttgtttgccactcatcttcatcagccttcatccctcccaaactaatgtgtcttttttctcatgagaagttttctatgtttacaaatgaagaagtttctaagtgaagattaagtcataattatttttgctaatcaaaattgaacattcttttcaggcaaatgtttttgttgttgttttctttttttggcttctaaatacagttgccctctgggctggctgaggcagagtacagaaagccttgttccaactgtccagagttctggttggcagaagacaatagaatagcgaacaggtgcctgtagtcagcacagcccagcttgtgtgtggagcgcagtaggtctcaaccatgataaagtggaaaaacacaaaaaccatggctactctttagtttcctatctttcacatcccttatttttctcctttgaggaggcagtttaagcacatcttgattcatggagagacctaaagatccaaagtatctaaaaagttgggagtagtggcacacacctatagtcccagccactcaggaggctaaggcaagaggatcgcttgagcccaggaggttgagtttacaggagctatgatcactgcatgccaacctgggcaacaaaatgagatcctgtctctaaataaataaaaggtttttctaaatgttctctctcctcaataattacaatttatgttttaacattaagaaacacatcgatatattgcaaaggtgaagggttgttttcctgcatcaggaccagtaatgggttaagtttatttaaaagtgcagcaggccgggtgcagtggctcacgcctgtaatcccagcattttgggaggccaaggtgggcggatcaagaggtcaggagttcgagatcagcctaaccaacatggtgaaaccccgtctctactaaaaatacaaaaaaattagccgggcgtggtggtgcatgcctgtaatcccagctgctcacgaggctgaggcaggagaattacttgaacccaggaggcggaggttgcagtgagccgagattgtgtcattgcactccagcgtgggcgtgagagcaagactccatctcaaaaaaaaaaagaaaaaaaattgcagcaaacagaactggatttgctcctagttctgggagagtcaagagtgctcccttctgtcttcactcttttctcaccttccgctctcccagtctgtctctcccctatacacagctcaggtcattgcagagctagtaaaccttatatcctacaaggagaaaacagagcagccaccctcactgcccctctgccctgtctcggagggctgcaggagtaatgagtctgaaccggcaagtgcaggcagaactcacacatagccatcctgaagcagtaacaagcctttctttggctctgcccatgtcactgttgttagttcagtgccagcatgggaggattcagagtaaaccatcattgaaagaaagtacagggagaaaaatggcaatcagggcactggtagatgcctagcagccacaaagcttcctcctcaccctctgcagtcaggctcttttggaaggcagcttcagagattgggaaaggtcagggaacaacagtagcctcttttaaaggtttgtattacgagacttaggaaggaaacgtgaatgagttgaggttatttagcctgtacgcgagaacatgaaaaggagtggaaatttgttttctttgagtctaagaagggttattttgggaagtgtggctaccagctattccctttttccattgcgggtaggccaagaaggtctgggtttaagttacagtgggtgagatggaagttaacccgtattcaagtgttttgagtgctgacggtgtgccagtcacagtgaattagcagaaggaagaagtgcgccagatattgagaagtatgggctctggggccagccagcctggctttgaattctggcttcaacacatagtagtgttggaaccttggacaaggtactatacctctaagcctcagttgcctcatctgtaaaatgggtataatatacctacttcctcatcagttatttttaagattaagagttaatataggtaaggtgctttaaaaagtggctggtatatattaatcacatttatatgtgataaaaataaatattagcatgagcagtagaaaggatcttagggtaatttgggccagcatttcattttacagataaagaggcagacatagagatagaatcgagattagaagccaattctgtagacttctagtccagggtggttgccactagtcctagctgttttaggacttcgtattgcttcaaaagcatttccctttaggttcctcttccttcccctcctcctgatagctggtatttctagagtacaggcatatgtgccctcatttaatcccttacagcaggctatgaagcaagtgccactattatccccattttctcagaagtgacatctgaggctcagagagcctgcccaaggctacacagaagttcagcctggattaaaacccagacctgacttcagagcctgtgctcttaaccacaccactgattttccttagaaagtcccagtggagtgcagttgtgctcagttaaaccatgtgagtatttgacagaggtgagctgcaggagccacagggcccagggagtctgaggatattttgcaatcccttttcaacctatgtctgctttgtttttatttttatttatttatttatgggtttttttttttttttttttttgagacaagagttttgctgttgttgcccaggctagagtgcagtgatgcaattttggctcactgcaacctccgcctcctgggtccaagcaattctcctgcctcagcctcccaagtagctaggcatgtgctaccacacctggctaatttttgtatttttttttttttttagcagaggcggggtttcaccatgttggtcaggctggtctcgaactcctgatctcaagtgatccgcccacttcggcctcccaaagtgctgggattacaggcatgagccaccgtgcccagcctgctttgtttttagacctggtttctcttatgtgtcttctgacacagtgcagttacactaaagcgggttacccaaagaatctacctgatgaagagagtgaagcttgaaggtcagagcagaccaagagaggccaggagcagagctcttgtgagacagggaccacgtggaggttatcagggctctgggcaaggatgctaatagaccagagatgtcagatgtcagaatccccaccttgaccagtggttcttcaccattaatccctatcagaccctgatgacagccttggatttccctctctcctggaaaatgcaaaggctcacacaccaaaaaagtattttggagtagcttcaagtttcataaacccccagcttcacctctgtgcttcgcagcatagtaattaaggtcacactctggattaaatggcctagggtgaaatcctcctttactagttagctgtgtaaccttgagcaagttacttaacttggtcttgggcctccagttccctcacttttaaatgaggataatcatagcatttgattgtaggattgttagaactaaatgagttaatgtatgtgacattcctagcacgtggttaactctatagtagtgttcactatataatagtattgctgcccttgcaccttagcccatttagtaaatgtttatggacagaatgaatgaataattctagttgagatgccatgcctggggtagagcattccaatcagcgtgtcgcagttggtctataggtttttttgggtttttcgtttgtttgtttttgagacggagtctcactctgtcgcccaggctggagtgcagtggtgcagtcttggctcactgcaagctccgcctcccaggtttatgccattcttctgccttagcctcccgagtagctggaactacaggcgccctccacgcccggctaattttttgtatttttagtagagacagggtttcaccctgttagtcaggatggtctggatctcctgaccttgtgatctgcccgcctcaacttctcaaagtgctgggattacaggtgtgagccaccacgcccagccagtttttgttttgtttttttctttttttttgagacggagtttcgctgttgttgcccaggctggagtgcaatgacacgatctcggctcaccgcaacctctgcctcccaggttcaagcaattctcctgcctcagcctcccaagtagctgggattacaggcatgtgccaccatgcccagctaattttgtatttttagtagagacggggcttctccatgttagtcaggctggtctcgaactcctggatggtctataattttgccaagatattgatccgctcgcccctcagggctgtcaaagccccagttggtcgcttctggcttgaagcagtgacatctgcaatgtgaacttctgactttaagcagcagcatctgcaatgcaatgtacaaatatctgtctctctaggtcccctgacatgaaaacagtttgggtagcaccagtcaaagatatcggttggtaagtcgtgagaatccagtaggcagtccagattccaagtccaggagaattttgagaatggatgtcaaagagagtcttcacgactgcactgagtttagaggccgtgggcttcctgcaggcttcacaagtgttggggtccactgctagagcaggctgcacaccacagtgggtacagaagatatcctgccagcaggaagcttcagtgcttcccaccttgcacatgagggacccagggagtcactcacaggatgtgtggagagcccacagtgtgagttgctggagaaaccactgtgacgcagaaaccaggctagagcccaaagccttgtgtaggcaacggacattaaacagatagtgatgagtactgaagtaggttgagcccagaggtgtgagtgctaggaaaaggtggtacctaggctgtgggagtttataacaacccagccttgtatgcaaggtggactctaagagctgtaggaaactatggaagggttttagtcaaggaagtggtatgtttagatttgtactctttttttcttataaatctacttttatttatttacttttcattagcttaagtccttgaggggcacagcgtcacacagattctgtgttcaatagctttagcaagattgcttgggaatttagcacaaaccatgccactgtttccatgggcctgagtttacctttccccagattatgctggttttcttcagtttgctgccagcagtcagtgtgttgttctttgctttatacatgtaagtacatctcttgcctaaatagaattagtttcatttcgagcataaataccttcaatttttttttttttttttttttttttttgggacggagtctcgctctgtcgcccaggctggagtgcagtggcgcgatcttggctcattgcaagctccacctcccaggttcatgccattctcctgcctcagcctcccaagtagctgggactacaggtgcccaccaccacgcccggctaattttttgtatttttagtagagatgggttttcaccatgttagccaggatggtctcaatctcctgacctcgtgatccactgtcctcggcctcccaaagtgctgggattacagtcgtgagccaccgcacttggccaatacctcaattttaataagagctgtgtcctcgctttggttctggaggccccacttacagctagcaaaaaatggccttggactacagccttccaaatgtattgtatttatcttattattatttttgagacagagtctctttatcacccaggctggaattcagtggtatgatcaaagcttactgcagtttcaaattcctggggtcaggcagtgctcccacctcagcctcttgtgtagctaggattgcaggcatgtgccactacacctggctaatttttttttttttgtagagacaatgtcttgctgtgttgcccacattggtcttgaactcctagcctcaaataatcctcctgcctcagcctcccaaagcactgggattacaggcatgagccactacaccccgcccatatttgccttttggaagtcctgttctcagcaggcctctacaggctccaagatagtgggaagagagctttttttttaaattcaccctgacagcataaacatgaatgttagaacatgagttggaagaggctgaggcaggaagatcacttgagcccaggagttcgaggttacagtgaactgtgatggagccactgcactccagctgggcgacagagtgatactttgtctctaaaaaaggaaagaaaagaaaatgaattggaaacagacaaaagtttatctgaggacataagttataaggctccttatagttgtccagaggtgaaaggtgagacatgcctgaaataagtacctggacttttaagggaaaaggaggactcaagcatgatcccccccccccccgccctgaagttctgggtggaaggcgataccacccctgggataggggatactggaagtacaatagttctggaaggttgggacacattgtgagttctgttgaggacttattccacgtgtggtacatgtgggatgttccctgaggatggttaacaagctcagtagataaatgggtccgagcacaggagagatgttggagtaggcagagagaaccatcagcagtggggttaactgcctgccttcagcagggctccttcctaaggggagaaagtttagaaatgggttttgatcagtgatttcttactttatgaccagtttgattggcatgcttctcttctatgcttaacttttagaattcttagataatgtgtattttgagcccttttcataaaaaccaatatagttcactactttgaagaattcatcttttttcttcttggctggctggcctcattaactccttccctgagtgtctttgcgataggagaaagctggttaactcataatgtgatactgtttattttcttagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggtaagtatttctggggacctcaggatcctgccctgtccctcagcctctggaaaggagtgtccatttctaagagtcccaccatcaccttgccctcccgcctgcttacccttgcccaccaccacaatttgctctgcattagaatctcctgtggtgcttgatgaaaagggaactctaaaataaaatgctacaagtcagacaatcccagtcataggaaccaatacctctcaaagacagaattcctaatatgtaataagcagttgataaatatttctggaatgaacacagtgttagttatgactccctgcttttcagatatcccctgtcacagttttttagtgctttctagaagcagtttatcatcttaattcaagtatattcaaacattcaaactactaagcatctgccatgtacaagatgctcttttaagccaggcatagtggctcatgtctataatcccagcactcagaaggctgagatggaaagatcacttgaggccgggagttggagaccagcctgggcaacatagcaagactcttgtctctaaaaaaaataataaaaataataatctgggtgcagcagcatgcacctttagtcccagctattcaggaggctgaggcagaaggatcactgaaacccaggagtttgagggttcagtgaactatcactgcaccactgcacaccagcctgggtgacagagcaagatcccatctcttaaaaaaaaaaaaaaaaaaagatactcttcctgattcagagaggaacacccaagcagagatctcatgccctaatccccactaggggatgccagaattgaaaatataggacatgtagttaaatttgaattggacgtaacaatgaatactcttgtaggatacatacatcccaaatgttgtagggacgtatgtataccacatactagggacatacatataccccttataagggatagacatatataaatgtgggattaagctgggcttggtggcatgcacctgtagtctcagctacttgggaggttcagatgggaggatctcttgaggccataagtttgaggtcagcctagacaacagcaagaccccatctaaaaaaaaagtagggggtgttaaatactataaaatactaaaataataataccaagttctaaaaaaaaaaaaaaaagtattgtttatctgaaattcagatttacctgggcatcctgtattttatctggcaattctatccttacactgaaggtacttaaaatcaaggtaggtgtggagtcagaataaagtgtttagggcaaggcctgcaggccagggacacttttcctttcttgccagtgttctcaggcagccagatagcattcgtgtcttccttggacagcaccttgaacaaggcaaatactgccttgttcctactgttcatttggcgttttctggactccatgattgtcactgtcctcctgaagcactgtcattgcaacattgccctcctttatttcaacacactctcagaatatatttctgctcctaagtttacagataagttgtttattgatttcattttaagttgtctgtttcctgatgatgactaaggagtccccttaatctcatcagtaagcactttccatatgacagtgtgtgggggtcccttctggaaaggtttcttgtcaagagctgtctgtgacatgtgggttcttgttggcttcatcttcttgagaacgcaacttctctagaatgcttttgaagcctgaaactctctgtttgcagacttcccactccaggtcttgcccctccagtgcagtctccatgggatggaagaacttagaactctagctagggttgtgtttactccttggacccagttagttcccgtgcctcagtcttccactgagaattaatggtcaaacaaatgaataaaaagcaagtgaccacacctgacctgagagagccactctttccttatatctatccttcttacgtatttctttattctgtcagtcttcctggctgttctttgcccactctgtagtgttgcagtgtgcacttacacacacacatatgcaaacacacactcactcacaacagattttccctctgctcagggtagagctctccttcagagaccagaaccacactttcctgaaaggcttctctgacttctcctctgaagcttttgactgaggcatttttgtctctgtctgctggaagccctaaaattgtaagagacttatctttaattaggatgagtataaaatgtattattcaaacccagcattttaaaagtggaagaatgtgctattaataaatgcactaggactgttccaggcaaactggggcgtatggtcacctctctgtaatgggatatgaggcccttgtcagtcagctgttctccccactgcctctctccattgtagtctctggttgtttgaggaaatagtaggctaagttttttcttcagacaactcttctcaacattttgttttctaccttgaagcagtacccactctgctggccgtagcttgctgatgctttcagaaccccaagtactgatgcccttgccaggacagataaattgttaaaatgagggtagcctactgctctgtgggtgggagggaagaaaatgggttcatcttccccccatctcagctgcctttcctatttcttacctttatctccaccttacctgcctttggttagttgtaggactgttagttactgaccccaagaagactcagtttgggagcaagtttggggattcctctaaaggggagacgtcagcagagacttgggctggaagtaactgtctttcccacctgagcgctcagtttcctaaacctcaatcttctaaggaaaggacaaatcacttgtcattaactttttttttattttttcttcctttttttttttgagacggagtctcaccctgtagcccaggctggagtgcagtggcgtgatctcggctcactgcaaccttcgcctcccgggttcaagcgattctcctgcctcagcctcccgagtagctgggactataggcatgtgccatcacgcctggttaatttttttgtatttttagtagagacacggtttcatgatgttggctagactggtctcgaactcccgacctcaggttatccgcctgcctcagcctcccaaagtgctgggattataagtgtgagccaccacacccagccttacttttttgttttttctttttgagacaggacctcactctgtcacccaggctagagtgcagtggtacaatctcagctcactgcaacctccgcctcccgggttcaagtgattctcctgcctcagccttccgagtagctgggacgacaggtacctgcctccacacccagctaatttttttgtatttttagtagagacagggtttcaccatgttggttaggctggtctcaaactcctgacctcaggtgatctgctcgccttggcctcccaaagtgctgggattacagatgtaagccaccgtgcccagcctttttatttatttattttttatttttttcagacagggtcttactctgtcacccaggctggactgcagtggcataatcacggcttactgcaacttctgcctcctgggctcaagcaatcctcccacctcagcctcccgagtaactgggaccacaggcatgcactactacatccagttaatttttgtgttttttgtagagacagggttttgtcacatagctcaggctggtctcaaactcctgagctcaagcgatccacccgccttggcctcccaaagtgttgggattataggcatgagccaccgaatctgaccatcattaactcttcaatctccctttctttcctttctcatttctcttcttccttccccctctgtcagactcactggacacaaggaagggtcgtctagttctaatttcaagagccttattagaagtgctttccagtaaggtaaaggaagagtaatatcttaggaaatctggaggcttgttaatttttatgctgcttgttgtgttgccttaggtgatctaattttttactagaaaattgaaatgaaaaatgagaggtcaatgaaggaacattactcaacagtggcagtggaataagaccttcatggacacataatagcataatagttgtgctcacatagttctctattgctttactttccatttcttctaaaatgcatattgggcttataataaaagctaggatttattgagggctgaccatatatacctggcactcttcccagttttttatattcgttaactcatttaaccctaacagcaaccctataagagacacagttttcaatccccattttaagaaaaggaaactgaggcacagagaggttagttaaataagctgtccaaggtcacacagctgttaagaggtagagctggaattcaaactctggaggcctggcctggttccagagtctattgtttttaaccattaagctatatatcctgccttcacaggggctcctggtcttagcacactgtcatagtgagggatgaggggatatgttttgattttgttagtttgagctatatctgaattttgacccactggggctcatccaggtttaagggccattagttcaagtctcagcaacttactattaggttggaagtttccacttggctgggcatgggtagaataataagtgaagttattcctcctgttagtaactggaagggaatctgttgggaggtgatgggttcggcaaggcaagtgtcttcacccttagtgtctcaaggcccaggcccagggagacagagcaagggaacaaggaagatgttacccatgcttagacctgcaggctcgtgcctagagactcaaataagcctcagctaaaaacaggcaggcgtttcttagccctcttctggtcctggcccatttctctctatttccactcttaacaggagagaagcttcttgaagggcaggtgatccagctcgaggatgggaccaccgcatacattcaccaggtgacggtacagaaaggtgagggcaccccaacacaccatgccttgtcgagggaagcctgacagcccccaccaagggacccctccatggcactgagctccagggaaaggcaggcattgctctcgttacagaagctctctcctttgaggatggtcagcctgtgcagctggaagatggcagcatggcttacatacaccgcacacccagaggtagggtcaccatcatcacaactcggggaaggatgggaggcaggactggaggatggggtggcaggactggaggatgggatggcacacaactggggtgtagacatgggagctgtcatctccatggtacacacatgctcacctggattagcagccttgcccaccttccctggtgcagaccacaggagcagctatgtctgcaactgggaggtgagccttggagatcagtgacgtggactttgatggtggccttggctccagcacagccacaaagtcttagggctttaaataggacccgaggatatcatccaagaccaggaaaaaaaactaatattttagaatgaagctcctaaggtgctgaagaataacaatttattccttccgcaggtggtttcttgagtgactgttgcatgcctggcgttgtgttaggtgtgcagtatacaagacagaacaaagtcagacacagtccccgctctcctagagtctagagggggaaacagaagtgaaacaagccatcagtgatgaactgatcattacaaacagagatcaggctcagggagggcttctctgaggtagtgatgcttgagctgagaggtaaagaatgaggtagacttagctgggggaagagggatggcagggagggttcagtacttcaggcagaaggaatagcatgtgcaggcctagagctggggggaagaaagaacagcacattccaggaactgctaggagctagagccctgggagtgaaggcagaatgagcaggaggaaactggagagagaaagacagggctggtgcactctgggtttgagtgtcagggtgaggattttggtctttatcctgagaccagtgggaagcatttaaactgttgaggcagttaagtgacatggtcacatttgtgtcccgcaaagatccctctggatgttgtgctgcctggagggaactagagggggtgaggagcgactggtcaggaggctattgtggtcatctaagccaaaatgatgatgggcccctgtcaggtcctcaaggagcttgtgagttcccatttagtgtaccataggagacctcatccttaggtgagacagctgcagaaggagggccagcaagagtgaatcacaaagtgaagggccatgagaaattggatgttgaaaccctccttggtatatgtatctctcattaacttaaagctagggtcccagctgtatctcttccccttgtgtggcatcagggctaaccgcgtgttccctgcagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggtgagcacgcacagcgtgacacggtctgtcactctagacaaccgggcctggcctgcgcactgcctcttggccctgccagaacttcacctctcaagaggacaagggcagccctgtgcttgggcaccatgtgggatattccctttgcccctccaccccagctcccccaactcacctgtcacacatcattgtctagggcatgcaacacagcctggcctggccgctgacagctgtttacgctcacttttgtttacgctgtctttgcagagggaaagctgccataagaaacagtggcatccttatgctgaggagttaggcccagcttcactttggctgctgtagtaatcctctgcactagctgggaaagccctgccagtgacttgtattagctttctagtccactgaggtaattgtatttatttcttctctgtgactcagtcatttggaaaattaacctcagtgggctatgacaagggcatgtgcaacagaacagctgggattcctggattatgaggcccacacagtagctcagctggaaaggaaaagggtcctggctctgcaaataccagtcagtccaagttctttctgccgaaaccatggtcctgcatgtggggaaaagggtacagacatctctgagctttccaaaccagggtgttcccttcctggaatgactacagagcctcaggctggatgtgccagggcttcctgcacgttccttccttccagcagttttacccgaagatgggggaggttttttatttataatgaaaccagtgtgactgaatgatggaggaaaaaaggaagtcctcatgtcttttcaaaatgaagcacaggccgggagcagaggctcacgcctgtaatcccagcactttgggaggctgaggcaggtggatcgcttgagtccaggagtttgagaccagtctgggcaacatggcgaaacctcatctctacacaaaaatacaaaaacaaattagctgggcatggtggtgcgcacctgtggtcccagctactgggaagcggaggtgggaggatcaggaggcggtgactgcaatgagctgagattgtcccactgcactccagcctgggcaacagagggagatcctatctaaaaaaaaaaaaaaaaaaaaaagtcacaaaactttacagtaggctacattcactcccacccaggttccctgaggtatatcttagagaccaaatttgagactcgatgttgatgtaaagagaagtgggttttatttaaatcatgagccctgagatctatgcttgctctacctctacctagtccaaacttgggtgagtccctcctctcctcgacctcagcttattcctaatatgatgagatgggaccagatgatctcagaggtcacttccatccctgatgtcccttgattcccgtgattaccccaggagctagtgagacatggaatgaaatccaagtgcctgtgtgggttagcccgccaagcaggtcaggccacctctgaccctaccctctacccagaagctgtttaagtgtccgtgaagctctcagctgcttgagcctctgagctggagcctaactagacagaccttgccatgaatttggcctcacccctctgtcccctgctcactgtaacttgtagagttcagtttcaggagctcctggaaagaccagagtgtgattctgaagcattctagaaagaaagactaagggatagtcccaccaggaccctgcccaggaaagcagaagagcaataagggctccctgcatccagaggctggtgtgagatgggtggctttagcaatatcccagaagaggagacaaaaggggaggacttgtcagctgggtgctgtcattagagctgacatttctggtggaaactgcagcactcccctgggtgcttctggtcgtggccacctcactctgggccccaagtcctatcagatgaacctaggtgagctcatctccacagcaagcccccttgtttatgtacttttaagcactagtttcgtgccaggaggaaggggacccctcccatcagaagatggaggtcttgagagttgcaggctcctaggtgtgtgtgcttagaaggagggtttctggcacttggtccagttcaagcatggccattcagacaacctcccttttcaccttacctagctgtctatgtgatagcctttcttcaatagccgtcacagccactatgacctgtaggtctccctttatcccatcagagatgggtggtgactccccatgcccaccctgtttcttctgtagcatgccccagcatctgttccttgtccgtctagttatgttcttctgccccagaggcccctgacaggtttaaccctgcctgttgggtcttaagctgccagcagggccctgtgtcccaccttcttcactggggagaatacatatagggatctcaagacttttcccccaggttcttcatgacagccagattccccgtaatggaaaagggcagcaagttggagacagagcattccgctgtggctacaagggctgtgggcgtctctacaccaccgctcatcacttaaaggtaaggttgctggcagacagccgtcagctctgcagtcttccctcccaggctgtaattctacctttctgctttgattggaattggtccctgccctcacgttgctggagggaagaaatgagggtacacaggaatgccagcacagagcgcttgacacacatgaatggtacaggagggaagagaatcagggtcctaaagaaaaccaaagagccctggtcatacccttgctcctctgaattatgtgattgcttgtcctcacaggtgcatgaacgagctcatacaggtgaccgtccatacagatgtgacttccccagctgtggaaaggcctttgccacaggtaacctgcctggtgggctgcttccagttgagggtggagggttctcgttctgtttgggacctctctgaagggaacccaacaccaggctgctttcctggagaaactaccgtcagagtactctgacttgcagggtgctctctctggaggaaaccttgttacgggagtgcaaggcagcatggttcaggccagcagaaggagcctggagggttggtggagagacccagcctcttgtgtcagctctgatgccaaccagctgtggattattgggtgggccattgcatctctctgggcttattttcccctctgtgaaactagtacctttagccatgagttctctaagtttcttttcatgctcatgttctggtatggctccaactgctcctggagagggaagcagggcagagtgggcttttccagcccctgcccagggcaggggtgggatagaggcagacatgggcttcttgagccaaaggaggtggagagcctgtgcatgaggtggacggtggaggatgagaccccactgggtgctcatctcaccccctgcctgccacatatggacaggctatggactgaagagccacgttcgtacccacactggtgagaaaccatacaagtgcccagaggagctgtgcagcaaggccttcaagacctcaggagacctgcagaagcatgtccgtacccacactggtatgctgggccctgcccactccaaccccattccctgggcaaaaggaattcagcttgcctttcagacttagacctggagcccagtgccatccccagcttgctccagcatggccctctttcccacacccctcctcacatcccaccatttgcataggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggtgggctagctggcatgcgaggactaccctcactcaggccccaacccctctactgtaggcttcccatctaagacacattcccaactcccagcccagaacccttctgtgccagccattccaggctggtctgggggtagggtatccccagaacaactctgcttgcagtgagtaattcctcaatttccagttaggtccaatctgaaaggtattgccagtcctctctggggtccctcagctccctaccacccctctacacccaccctgagttctccaactctgactgaactcttgaaaagaggccagggtcaggaatgatggggaagaagcagagtgaactgtcaccttcaactcctcaccttatccgccgtccatgactcctgtgtatcctcaccctccccagtgttatgcccctcatccagctttctgtgttgtgtctcagcatgtgtgtcccctctttcccatcacaactgatacttcagtcatccttgcctcttgcctctgctgttcaccattctcaacctcccaccctcaaccttataagccccagtgccccctaccagccccttcactagccccagccttgccctgtcccccgtttcctttccgccttgtctctggattcagtggttcaacacctgtgtcctctctgtgttccactggccatcttccccaaccctgtccattcagagtctcaggtctcagtccctctccctccctctggctctcccttcaccaaccctgtccctcacccctgtccccttagtttcccccttgccagccccagttcccacccccctcacagcccagtgtccccaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgagggtaaggggagtgggcagagggtgagagtggggacaagccaggcctccccatggcatctggtagcagatgtcagccttggctctcctctcccagccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtacaggccctggagggcagaggtgccatactagctggcactctccactctctctggggactctgggagccctgaagttctgacagccccactgccacccagcttcttgtttaagttttatagacttcagaggctgaggctgaggagaccacatcttgcagcacagcctctcctcctcctgtgcttccagctcagtctctggggcttctagagcacagttagtagtttctctctttacttggaggctgacaggtcctgttcatctgaacaggatatgggatgtccttctcaagagaggcatgttcatatagcagccagaacatggtatggggtctgaaagcctggggtctggtcctactagtgtactagctagctatataacctgacccttgtccgtacccttgctagaaagtacatctgtgctttctagagttgttaggacacaatcaggtggcgaccctgagctggatacaacagggcccagaggcaaagtggtgataaatagaagtagtcagtggaattcttctagtgtggcctctctttgcaaccttggacccattttgtttgcctgtcacccatcccttccaccactatgacatgaaactaataagctgaccttgtctgggagagcaggtatatcttccttagggactttcagacaaccctccactgacactgccagctcatcttcccctcctgttggcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtatgaccaggcggtttgcttggggtttcttattttgtcattcctttccatggggcgggcattaaagtgcagcctaaactagtcaagtcttcttaccaggacaaagattccccacaaaagaaggggtcttccccacagttcctgggccatgagcagctcttacctttaaaagcagttgaatggaggtcaagagacactttctaaatctcaattcaaccctgatttgttgtgcaaccttaggcaaatcacttttccatggacttctgtccattttcaagtgaggggattaaaatatctctggaattttttacagctctgtccttctgtgattcaaaatccctaaattaaattgggctctaagttgggaggaaacccagccttacttagctctgagcctcaggctaattaatctgacccatacggttttatccattctcttctgggttgttcccagcaccttaattggagggatgtttatttggattgtggggagggagagtatactgcaggtggaatggaagacctccttttgtctttcaggtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggactcttcatccgtgaacttcatgtttattggagccctactaagtgctcagcgtgtggcactgggtagatgggggagagtcaaaaaaaaaagtaggccacatattactaacactggaatctagcagggagggtctcactgtctccttccttctgcacccccttccccacagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttccacctgggtccctccatcctttcagctctaggcccgggtggcagggttggtcaaatcaggctatcagccctgtctccctggcacaaaccccactcagccttggtgccagagtggtggggctggcctgccagggacacaggtgggaaggaagcccagtataagataaagccctgaggagctgctggtggcttcttgcccacagctgagcaggtgggctccagggtagccaaacaggaccagggtgaccgctgcttccaggctctggctgaatctcaggcctcatgtgattgagctgggggaactcttttcctgccttttcttgtgaaacgtagtcagagcccctccaacccagccacccccaaatcacacagtcagcttctccaagagggcaaagccccaggttagagtgaggctgggggacacctttgccaaggttactgagattcaaggagcagagtctgatgcctctggagctgaagtcttggctctattacccagctctgggggtgcccacctaggtgcctaggactgtgctgtgggatttcaaagccacaatcagaccccactgaaaagtgagttggtgagaccagatcagctccagggggaagaagggatacaggggaaggcacttgatgggaagaagctctgggtttgactctgcctacacaggaacattgcagggattggtggtgcctcttttcctctctctgctgtgatggatatgccccaaccccttcctgcctcctaggattggaaccccctcctctgatccaggcatcctctcccaggatgcctagaaagctcccatttactcttgccaccagctccttgggaagagaggggcgggggcgtgcttccaggcaggaggtattcccagcaccttacttggagggatttttatttggcttagggggtagggggaggtgtcttagaattggcctgagcagatgtcttcaacatctgtgaccaccattcctggtgtgggcgtgtcccagtccttttggacactggatctgaagaaaggaagcactgacatggagggccctgaatcccaagcctgctgctgctgggacccttaaagttgaggtgcaccacaaggctcacccccatgtgtttcaggaagtttccagtgtcttcagggctactggggctagagtgggcagtgctctgagtaccgtttagagccagtgctgaggggatagggagccagcaagtcaagtgccacatcctgacctggagaggtgccctggcccatttccttctccagctttgtgatgttgcctttgtttccttccacttggatggagtcccaccaccatggtaatgttaagtagcaccaaaagctctacccagagcctactatgtgctttacgtccattctcagacattcttacaacacggaggcatttttcctgctttacaaatgaggaaactgctcaaggaggttaagtaacttacccaaggcctcctatgttgaactaggactggacctttactctgtctgaccccaatatcaggatgagcttgctttttccctcagcaagctgcgtctgggagccctggaaggctccagaagcctccgggtctgaggaggcttctaaaagggcctcacatgccccgggagccacgtggatacagaacgagggttcccgctctcggagagttggtccccagttcccatgcagggagtggagcctctgagcactgccagaacaacaggcagggttctcgacagcacagagcctcacgcaatgtgcaggcaggtggtgctctcgctccaccacggcacctctgcggtctctgcagccgtttgcatttcctgaaaccggatcttagtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgaggggcacccgggacccgggggaggacggcagatgcaccacaccagcccctgccgcctgggagccaggtgtggacactgtgccactccaggggcacccagccatccagcgtcccgggcctggggtcggggggctggtcctgggtaactgggccaacgtagcctggtagatgccgctgcccaccctccagagacctagtgaagtgtgtgcagaaaccttgcgcagaactgggccccacaactggaggccaggaggttctgagggccattatggggttctgagggccaggagccaggccacatcccagactctgtgtgatgagcacacacacctccacagagtcatgcttgggcacgcagtgtgctctttcttgctgcttcctcctgactttcaagagaaacagttagccagtgcttggcagtcatttcctctggagctgagagaggcataaaggggccgcccccagtcccaaacctgtctggcctgtctaaccctgcccgccaggtgggacagagctgcggagtgggtgaggactgaggaccctattatactgctacgcagctcacccccctatccaccacacatatcaggttgggaaacttaccttaggccttgagacctcaggtagggaagggggagaatctaagcccaggaaaatcccaatcaatgattgtcctgaagtcaatcatctggcctagacaatttctgggaggccaaggagtttttctctctcttcctctagtcctccagtagtgctgccttccctaccctagttagtggggaggaagcaaggccctcagccactagaatcagcgaacactgggggaaaggagcaaggtaggcctcagctctctaggacctgccataggggtgccttcgttcactctgcaagtacttgagtgcccctcgtgaggctctgtgcctggcatgtggctaggcactaaactggtgtctccctgccccatcctccaaaggagacgtgtggtctcaaggaaacctccattcttaatgaccgaggtagagggtgctggatacctgagagatgaatgggacagaacagttattgtgccccaccaccgttccaaccccctactttactgaacttggatgtgaggaacttgaatatcccaaactggtcctatgttaaattccttacctggatttgtgagcatctaatagatgatttcactcccccaggaaggagagcccactactatcttttgtcacctagggagaacctcctaacaggcagattcttccttacatcctatttaaatctcttgtattgcagatcatgtcatttggttgggtcctcagtataaatggaaaaaagtcgatcatccaaaatccatttctgcaaactctgtgtcccacccctacctcccaccctgtccctttaatatcttgccagacaataccagcccccgtggctttttgcttccagggtaacattttccacttctgtattacctgtggccactgagacctctccaggctctctctgcccttcacatggaaagtacagcctttaagtggctccccttttcctggtgccatcagccagtaaagcctcctagcttgagcctctgtcttgccctctaaaagggccactacccactccctcatccccacaggttgcgtatttctagggaaatactccatggagagcttgcatgcttgaactgtccactgtctgtacctcatcacagctcatattgaacctactgccagcaacatctctggtcacacaggatcaattatagagttccctcctacttgacagaaaacttgtcaactctggaaacctgggctaacagtgggagtctcaggggccaagtgggggtggggcggaaatggcggggctcctttcaagcccataatagtgaatattggaagaggaggaagtagtgatagtgttggggggcggggattccagcaaagcaaaggagtaatagagaagtggtcaaaaggcaaaggaggaagcagacgagagagttatacaagcagggcccacctctccccagaaaagacttggggatgagggaaaagaccttggagtcaatctggttttttgttgttgttttagagatgagatcttgttctatcactcatgctggagtgcagtggtgcagtcatagctcacgacagcctcaaactcctgggttcaagcgatcttcctacttcagcctcctgagtagctgggactacaggcacatgccaccacgcctggctaatttttttattttttattttttagagcctgagtctcattatgttgccccggctggtttcagacttctggcctcaagtgatcctctggcttctgcctcctgagtagctggaattatagtcttgagccacctcactgggctggttactaaaaccatccctagcgttagggtcctgggttggaacctggcaagagacctgcactagcccagggcaagatgtgtcggtgcgtgacatttgccacttctcccctaatgtgttggtagacgggctcccagtggctgtcctgggcaaacccacgatgaggccagagggtaggaggaagaacagcacgtcctctgagaaaagcccaaggagtagggttgtttctcctggaaaagagaaggcttgagggaaaaaccagatacttctttctctctttgaattcttgtagaaagtacaatggcttcatccagttgggttgagaacagagaaagtaaaccaataggaatggcactcctgcccaggatggatttaggttgaacacaaaacttcccaggagttgagggctgtgagttcttgcaaggttcccagaaccgcctctaaaaacctttggaaggtagccatcctgacagagggctatagagaggggagcccttgggaatgatgtgtgtcctactgaacacaccctcttacccaggggagcagttttgattttagaactagtggaggatcagctgataatttggcctccttccccactgactatcaggcagtggggtgaaggggtatgtagatggagcagtgtgtctctggtttgatgaggatctttgggtggcaccaggcctaccacttcctccttgactggcaggagctgggggaagggagggagggtagacaggggccttccagtctcctgcacctccagctgatattcagggcagtcctggagcccagagtgagactcttgcccactgagaatcaatgagcttcaggttttgcctcctctggagagggacaaccaccttctccttagtggaggaaaagttaagaacagctccagtccaaaaacctgctggctggctaggatcattagctttgtcctgacccctgtgtgctactggtctccccaggctaggatttgtgggtagggaggggaggatgatttaatgatgtgcagagcacttgactcagaaccacgcaggcttggatccgtactgctccccatctgggtgactttaagcaagtcactgtccatcttcagtttctcatctataaaccagggggttgatcaccaagctgtcctacaaaactaaagaataaattctgtacctcaagtaggtaaaattggtctatgatgcagcctctcctttcccttaactgggcctctgtctcctttgatgcccacacccaacccctacagccccttcttgctctcagcaggtgacacagctaatccaaagattcccaccttttaaaatttccagtgttcctccatgatagtagttatgcttttctagtaacccactagaatacatttggtaactcttaaaaggagctgtgtctttttttttttttttttaagacagagtcttgctctgtcacccaggttggagtatagtggtgcaatctcagctcactgcaacctccacctcccaggttcaagtgattctcctgcctcagcctcccaagtagctggaatcacaggtgcccaccaccacgcccagctaatttttgtatttttagtagagccggggttttgccatgttggccaggctggtcttgaactcctgacctcaggtgatccacctgccttggcctcccaaagtgctgggattacaggcgtgagctactgcacctggctggatctgtgtcttttaaaaggatcacttggaacctagattcatttaaagaccttgctgggcaaggtggctcacatctgtaatcccagcactttgggaggccatggcaagagaatcacttgagtccaggagtttgagaccagccctggcagcatagcaagaccccaactctacaaaaaatgaaaaaaattaggcatgatggctcctgcctatagttcctgctactctggaggctgaggtggaaggatcgcttgagcccgagaggtcaaggcttcagtgagccatggttataccactgcattccagcctgggcaatagagtgagattctttcttaaaaaaaaaaagtcaatttaggagagaattctttctgaaatcattgctgggtgcttttatggattcccaaaccctggggatcctgaaggctggaaactacagaatcagttcttgctgactgttgccaacatggacctgacacccacacttgagtttttaggatccccaatccccacacttgagttttagaggatcccccaagtcctgagaggagaactactcccctacatgcctccagaggaaagagtgaatagatgaagcatctcaaaggtcagtgactgccaactcagaggccagaggctccctgggtttgtggagactgtgggagtcctctctgaggaaacccaaatggcaacttgtgaaaaatacacctggaccccacccctggaaactctgagtcagtaggtctgggctgggcgggcatgtttcagtttcaccagttctctgggtgattgtggtgctcagccagggccagtgcactgtagagatcaagagcagggctttggagtcagaccttgggcaagacgcttcctctctctgagccttgatttcctcatctctaaaatgaggataatgagagtcccctgatccagggctgaggactgatggagatctgcaagtgagctcctgctcacaactcctctgtcactgccatttcctttgcagcatgacccctcccctagtcacaccctctctccacccccaacccctaccgcacccaggcacaggaagctgacagtctgaggtcggcccagctctctggagagaggccctgagtgtctgggcatttaattcttccttgtcctactatctgacagcacgcgggggtcagagtctctgccctgggttcttcaggatccaatggcaaaagtgcaggtgaggtgcaggtcttagggacagtacagggcgacagaactaagctcaaataactgtgctgttatgtggcaggttctgtcctgggtcggggagggcattcataggtcctctcctaagactccctttttagagagatgaaaactgaagcccagtaaggttaatatgctcactgggatttagtcaatctctgtctggcttttgtattttgtctgcttcttcccatgaagtgtttaagttcattcaagagatacttaatgagcatccattaggtgccaggccccgtgataccacagtgaaaaaaacgcaaatgtttctacccttgtggtgctgacattctagtcagaggaggcagataataaactaaatgaaatgtacaatatgatgaaagatgatacatgacatggaagaaaataaagcagaaatgggtagggatcatggaggtcaggcaggattgggttacaggtttaaataaggtgatcaggccgggcagggtagctcacacctgtaatctcagcactttgggaggctgaggcgggtggatcgcttcagcccaggaattcaagaccaacctgggcaacatagtgaaagcccgtccctacaaaagatagaaaaattaggcccagcacggtggctcttgcctgtaatcccagcactttgggaggccgaggcgggtggatcacctaagtcaggggttcgagaccagcctggccaacatgttgaaaccccatctctactaaaaatacaaaaattagctggatgttggtggcaggcacctgtaatcccagctactcaggaggctgaggcaggagaattgcttgaacccgggaggcagaggttacagggaactgagatcacaccattgcactccagcctgggcacaagagcaaaactacattgcaaaaaaaagaaaacacacacacacatatacacacaaaaattagccgggtgtgatggcgcacgcctacagttccagctactcaggaggctgatatgggaagatcacctgagccagggcggtcgaggctgcagtgagctgtgattgtgccactacacttcagcctgggcaacagagtgagacccagtctcaaaagataaggtgatcagaggatattccacctggtcagggaatatatattccctgagaaggtgtcatctaagtaaaaacagggaggaggaaagggtttgagccatgcagtgacctggagagaaatattccaggctgcaggaacagtaagtgcaaaggcccttgggcaagaatatgcctgacctgctggaggaacattaagaaggcagaatggctggaggcaagtaaacaagagggatgaggtcagagaaggtgcagcaggccaggtcacatggggcctggaggcctgtggaaggactcgaacttttactctgaaaattatgggaaaccattggagcatttgagttagactttaggagtcagtcagaaacattcagtgaatgggggacattatactatctttggagtcaaggttgagattagagtcattgctgccctcaaggaatgtagaacacccagaaatgctcacacaaacagtgaacagcaaaagaatattattatagagcaacttaatagggcaaattaataactgggttaatggcaccctttttcatccctattgttttaaattttatcctaaagacaatatattctcctggtttaaaaaaagaaaacacacagaagaatataatgttaatgaagaaattcggggctgcgctgtggtagctcatacttgtaatcccaacactttaggaggccgaggcaggaggatctcttgagcccaggagggctcttcctgcctcggcctcctaaagcattgggattacaggtatgagccaccatggcctgggcaatataatgggaactcatctctatgaaaaaaaagaattttttttttttttttccagacagggtctggatctgtcactcaggctggagttcagtggcacgatctcagctcactgcagccttgacttcctgggctcaagcaattctcccacctcagcctcctgagtagctgggactacaggagtgtgccgccacacccggctaattttggtattacaaaaaaattttttaacttagctgagcatggtgacacatgcctgtagtcccaattactcgggaggttgaagtgggaggatcgcttgagcctgggaggcggaagctgcagtgagcagaaatcgtgacactgcaccccagcttaggcaacagagtgagaccccgtctctaaataaataaacaaaaataaaaatgaatttattataaaattaaaacatgttagtggtaattttttttttgtgggggtgtgtgtgtgtatgtgtgtgtgtgacagagtctcactctgccacccaggctggagtgcagtggcactatccttcctggctcacctcaaccgccacctcccaggttcaagcaattctcctgcctcagcctccctgtaactgggattacagccgcctgccatcacacccagctaatttttgtatttttagtagagatgaggtttcgccatgctggccaggctggtgttgaactcctgacctcaagtgatccgcccacctgggcctcccaaagtgctgggattacaggtgtgaaccactgcgcctggccaaatttgtttttttgtttttgtttttgttttaatttttagatggagtttcactcttgttgcccaggctggggtgcaatggcacaatctcggctcactgcaacctctgcctcctgggttcaactgattctcctgcctcagcctcccaagtagctgggattataggcgcctgccacaatgcctggctaatttttagtatttttagtagagacagggtttcaacatgttggtcaggtgggtctcgaactcctgacctcaggtgatccacctgcctcggcctcccaaagtgctgggattacaggcgtgagcccctgcacccggcccaaaaaaattttgaagtaaagaagaatataatgttggccgggcgcggtggctcatgcctgtaaccccagcactttgggaggccgaggcgggcggaacacctgaggtcaggagtttgagaccagcctggtcaacatggcaaaaccccgtctctactaaaaatacaaaaattagccaggcatggtggcgggcgcctgtaatctcagctcttcgggaagccgaggaaggagaagcacctgaacccgagaggcagaggttgcggtgagccgagatcacgccattgcactccagcctgggcaacaagagtgaaattctgtcttaaaaaaaaaaaaaagatgaaagtttctcccctcactctggagaggtgatcactgttaacagtttgtgagtcttctagattctttctgtatacaaataaacaggttgaaccatatgaaatttctgacacttgattgttttgacctactgaaatactagtttcatataattcgacctaatctttgcacatgtatttgacaaacatttcattctgtagcttgctttttttacatgccagtgtagtatgcatatctttcaatgtctgttcatataaacataacaaagatcacccacaacttttattaagcagtgcactatgcaccaggtactcttcactcaaaacagcctttggagcagaccctatcattatcctcacagaggaggagactaaggtgttggagaattaaacatttgcccatgagcacacaagtgggaaaagtgaaatctttccagctacatacagtggttcctgacatggtatacctgtttcctactggaagagcctcagtttgtctccattttttcatattataaacaatgcttaatgagcattcttgtatctctcccatgagtgtctgtaggttggatgattagaaatgctggggtggccgggcgcagtggctcacgccctgtaatcccagcattttgggaggccgaggcgggcagatctcctgaggtcaggagtttgagaccagcctggccaacatagcgaaattccatctctactaaaaatacaaaaattagccgagcatagtggcacgcgtcagcaatcccagctactcaggaggctgaggcaggagaatcacgtgaacctgggaggcggaggttgcagtgagccaacaccgcgccactgcgctctagcctgggcggcagatttggaacgcgtctcaaaaaaagataaggacacgggtagtttgaaaagaggccaagagacagcagatgagaatatataaaacttgaacacttgtcacttcagaagtggtcagtggatgttggcattattctcttgaggtggtcaccctgggttttaagtgctaggcattgagccagtggcaccccttagagtggggattggtattctatgaccacagatgtgttaggcaagactttcctggaattagtgataaaaccaaactcaaatggcttaagggagaggggatttattggctcacataaccaaaaactccagggataactgcccagagggaaatgagggaaaaaaaggaaatactcccttcctgggatctcccacttcccagtttgccaaggaaaactgagccccaggaggacactgaggcaaagtctcaatactttctccccctcctctctgaaaagagaataaaatgaaggcttggcacacacaccatctccgagacagtgctagctcctgcctcctaggaactgattccaaggtgaactgctggtggtggaagaagcccttcaatatagcatgtattgattgcacttgatgtacaaaagaggacatagatgctgagggacataaagatgaacagagaccttgtctccagagttcacaatccaacggaggagggagacttgacatcagtattctagtaggaaggcaacctgtgaaccaggcacatttagtttcaacctcagctctgccatttactcttaaaatttccaaacctctgtgtcttcacctgaaaaacaggcttaataatatttgcgtatataggtgattgtgaagactagaaatggggtataaaaagcgctttgactgggtgtagtggctcatgcctgaaatcccagcactttggaaggtccagatgtgaggatcacttgaggccagcagttcaaggccagcctgggcaacatatgcagacctctgtctctaccgaaaaaaaaaaaaaaagttttggccgggcatggtgcctcaggcctgtaatcccagcactttgggaggccgaggtgggcggatcgcctgaggacaggagttcgaggccagcctggccaacatggtgaaaccctgtctctactaaaaatacaaaaattagctgaatgtgatggtgggtgcctgtaatcccagctacttaggatgctgaggcaggggaatcacttgaacccaggaggtggaggttgtagtgagctgagatcatgccactgcactccaacctgggtgacagagtaagactccgtctcaaaataaaataaaataaaataaaataaaataaaataaaataaaataaaataaaataaataaaataataaaataaaataaaataaaataaaaaacagttttaattaaataaaccacctcctacagtgaccggcatatggtaagtgtgcaatagtaactagtgactttttaatcatttacactgcttgtgacaaatgctataatagaattaccccaaggagattttattttcaccagatttcagatttcaacccctttattctaatatcatggatttgttcaacaaacccacatttcccctgcacaccattatgaccactatcccttctaagccttgccctctccatgtcatggaccatttttcatgacccttctttgagccctctcctctcccagagcagacacgcttaggtgataggcacactgcagccaggacactgagtctttgatggaaaccatgataaattggcagcttctgccctggggtggcagactaagtccctgcaaaccctgcaaactgtctagcattgtgggaagcacttgggctttggaatctgatggagatggatttgaactccaagctcttgttcagtgtgggtcttttggcaagttactgaatcccttgagcctcagtctccctgtctgtagaaagaggacaccaatacctaatgaagtggctaagagtataactgcatgggtttgaattccagttctgccagctgtgaccttgggtgagaaatatctcagggctgcaggagttttcatttgtaaaatgggtatatgagtagttgttatggtggttaagcaaatgatatgtaaagtactttagctcagtgcttggcacatagtatataagttttagttattactgaactgaacagtgtgtgtagagaactcagccaggatggggtgaggacaagcagagaggtggggagcagtcctctggcccagttttggttggggtgcagaaagacacactgccactctactctatcccaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggggcccagcttgtagggagcatctgtaacctctccccacttttccagcctggccagcagcctaataccttgccactccaactcttcgcccctgccataaactcctacttctgcctgctctgtccgtgactgctgtcccatcacgtccctcacatcccagccacctgcccccttcctgtccccctcaattcaccttcaatgtccctcatctctaatgaggtgggccccaccctacccataaccttccaccgaatccctgcccggccctcctccagcttccagggttctccacccttcccagactgtccccctgaactccccctccaactcctccaatctgtcactgtgtttccaggttcttggctcttagcttcctgctgggtttctccttctttgtcctctgggctgaaagactagagttaatctgttgtcagggggcctgggtgggtgtgggtgtgttgtggagggtggagtggttggaaccagctagttacctggtaatcagctcagggatcccttgagttagggccctggacttggccaggtggggagcaggggcatagatgaacccaagaaacccagctggagcctagtgtcgtggtagagctgagatatgcagtcagctgatttgcagccctggtggcaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtgagggtgatggcagccccagggactgaatcacttgggaccagacctaagcaaaaccatgaatgagaccaaaccacctttggtgccttcccatatcccctttctttctttaccatcttcccatgctggtatctgtcctcacccagctgtctccagatgcctagaactgcctgtgtcagagtaattttgccttcttccaggaaaactgaaattacactttcatgagggttctgctggtcctcactgtaggaaaatgatctgcaaattctgtttacacagaggtctaaatgccagatacattactgagcattactggcaatctaggaagggtgcttttttttcctttaccttttgccacttcttccaggacaggaaggatgctttacaaggcaaggggagacctttctgagacaggaggttactctggttccagattttccctttctgcctttcttctggaaagccaggacaaactcagctaagagacccagggatagggcatcctgggagaaaaggctgggaatctggtccctatctccttactcctgggtgaagccagggaaggcattttcccatccacctgtaccctccctcttatcctcacttccctcccctgcccatttggccttgtgaccctttagtcctcttggtggctgtggagatgccagggtgactttaggtctttagagtggggtttacaggagagggggcttctgtacttacaagaagccctagcatgtcaagctccactcacatttgtcctggcttctgtttgtgggaagggtgatgaagggaaccacccgagccctgaaccagtgccctctactaaacacccaaacaagacccaggatcccccagaaagtcctaaacagagtgtcccaaaaagctgctggggcaggtgagggacatgtgtccatctgcacatacacttggctggctgcccttgttagacccctgccagtcagggcaaggtggcctcggaggccaggaggttgtttgcttctgcgatcaacatacagagttaacaactgcagcaggatgtaccccagccaccacttccggttcctctgtaacaggtttcctgtccctgcccagcttacctctactccccactccccaacgcctacccctaccccaaatccccttcctctcccacaagggaaagatccccagggttggggattggggcttggaataaggacctgaatgggattcaggagatcagaatcgggttctggctgcccccagtttgctgtgtgacttagagccagtcacttccccctttgggcttttttttggtcatctgcaaaatgagtgattggatgagagggcctttgcactcccttgacactttctgtgatttattgcctctttctggaccccagatctcaggtccccttcaccttgcccttaagacaggaaggagtgggactggaggttgtggacggggagagaaaacctgagttggggttggggctccaggatcctctcccaggtcttttccctggctccataacattcggtcctctggccccctcaacgctctgtcccctgtttccctctgcccaggctctgggagccagatagagcactccctggtgttggtgctggcaacaccacctgctgcagctaccaggccttccttctcctgctccaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcaggtcaggcaagctgggaactaggggaagcacacaaggtgcagggcgaaggggggcctgggaagcctctgacgtaactccggctggcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgaggggcaggatgggggtggaggacatctcagggcccagagtgtcctcaggggcatgagaagacaagggggtcaggagaggggcaaatggagaaaagccacagtgacacaaattcctgcttagattagtgtgacccaaatatatccggatgcctcaaggccattctcatccacgtcagcacttaaaactaaaactgcaactcaagcaccaaagtaattggtgaataatatggaatttgctcaagatttcagaggaagtggcttatatctatactacacagcaaatctttctaaaaatcccttttaaaggtttttcttcttcacccatattccattccctttagcaactctgtacttccctattctccttccatacccctctcctctgtcttccccttctgtttcctcccttgtgttcatcactattttagaggcttaaaacacaagcgtctttactattttaaataatatgtatatatgtgtgtgtaacatgaaacttcccattttaactattttaagcgtacaattcagtggcattaaatacattcatgaaattaaaaaattcttttgatatataacagatgtacatattttcagggtacatgtgataatttaatacattcatatattttataaaaatcaaatcatgtcattaggtatcctttacctcaaatatttctttatgctagaaacattcaaattattctcttctattttgaaatatacaatagattattgtaaactgtagccaccctactgatctattgaatcctaggtcttatttttcctgtcaaactgtatgtttatacccattcatcaacctctctttgtcctccccccacacttcctggcctctggtaccactaatatactctctatcttcatgtgatccacttttttagctcccacatgtaagtgagaacatgcgatagttgtttttctgtgtttggcttattcacttaacaaaatgacctatggtgccatctatgttgttgcaaatgacaagatttcattctttttatggctgaataatattatatatatcacattttcttaatctatttatccacttctgggcacttaggttgatttcatattttggccattatgaatatctctgcagtaaacatgggaaggcagatatctcttcaatatattggtttactttcttttagatatatacccagcagtggaacttctagatcatatgatagttctatttttagttttttgaggaaccttcatacagttttccatagtagctgtactaatttatattcccactaacagtttatcagggttcccctttctccacgtcttctccagcatctttttacagaaaagatattcttggccaggcgcagtggctcatgcctgtaatcccagcactttgggaggccgaggctggtggatcacctgaggttgggagtttgagaccagcctggccaacatggtgagaccccatctctactaaaaatacaaaaatcagccgggcatggtggtgggcgcctgtaatcccagctactcaggaggctgaggcaggagaatcgcttgaacctggagatggaggttgcagtgagtcaagattgcaccattgcacttcagcctgggtgacaggagtgaaactctatctcaaaaaaaaaaaaaaaaaaaagatgttctctattttttttgtaaaaagccattttaactgggatgaaatgatatctcatttaattttgatttgcttttctctgatgattagtgacattgagcattttttcatatctctgttgaccatttgtatgtcttcttttgagaaatatctattcagatcttttgcccatttttaaactggattatttggttttttgttacagagttgtttgagctccttatatattctggttattaatccctcgtcagattgatactttgcaaatattttctcctattctgtgggttgtctcttcactttgttgattgtttccatggctgtcctgaagctttttagcttgacataatcccatttttctatttttggtttggttgcctatgcttttgaggtcttccacaaaaaatctctttgcccagaccaatgtcctggaatatttctccaatgttttcttctagtagtttcatagtttcaggtcttacatttaaatgtttaatccatttttatttgatttttttatatggtgagagataggggtctagtttcattcatctgcatgtggttatttagttttcccagaaccatttattgaaaggactgttctttccccattgtgtgttcctggagcctttgtcaaaaatgagttctctgtaaatgcatggatttatatctaggttatctattctgttccattggtctttgtgtctctttttatgccagtactatgctgatttggttactatagctttgtactacattttgtttttttgttttattttagagacaggatttttctctggtgtccaggctggagtgcagtggtatgatcataggtcactgcagcctcagtctccttgggctcatgggatcctcctgcttcagcctcctgaatagctggggctataggtgtgtaccaccgtggccagttcgtagtgtattttgaagtcaggaaatgtgatgcctccagcttcgttctttttactcaggcttactttggctatttgaggtcttttgtagttccgtataaattttaggattttttttctatatctatgaagaatgcctttgctattttgacagagattgcaccaaatctataaattgctttgggtaatattgttattttaacaatattaatttttccaatacatagcatgggatatctctccatttttttgcatcctcttcaatttatttcatcagttttatagtttttcttgtatagatctttcactttggttacatcgattcttaggtattttacattctttgtagctgttggaaatgggattgcactcaacttctttttcagattgtttgctgttagcgtatacaaatgctactgggttttgtatgttgaattatcctgcaactttactgaattcattcatcaactctaacggttttttgttggagtcccttttttttttttttttttttttgaggaggaggaggagtcttgcttttatcgcccaggctggagtgcaatggcacgatctcagctcactgcaacctccgcctcccgagttcaagtgattctcctgcctcagcctcccaagttagctgggattacaggcacctgccaccacacctggctaattttttttttttttgtatttttagtagagacagcatttcaccgtgttggccaggctggtctcaaactcctgacctcagatgatctgcccacctcggcctcccaaagtgctgggattacaggtataagccactgtgcccggccttttttttttttttaagagagagacaggatctcactgtattgcccaggctggtgtcgaactcctggcctcaagcaatccaaccacctcagcttcccaaagtgttaggattacaagtgtaagccaccacgccccatggagtctttagatttttctaagtagaagaccatgccatctgcaaacaaggctaatctgacttcttcatttccagtttggatgcccttcatttccttctcttgcctaattgctctggccagaactcccaatactacatggaataaaagtggtaaaagtgggcatccttgtcttgttccagatcttagaggaaaggctttcaatttttctccatttattacaatgttagctgtgagtttgtcatagatagcgtttattattttaaggtatgttgcctctatacccaatattttagggcttttataacacgatgttgaatttttttagaaagctttttcagggtctattgaaatgatcatatatggtttttgctcttggttctgttactatgatgtgtcatgcatattgatttgtgcatgttgaaccatccttgcatccctgggatgaatcccatctgatcatggtgaaagatctatactcacaatattgtacaaccatcaccactatctatttccaaaactttttcatcacaccaaacagaaactctgtacctaccaagcaataactcctcatactccctgaccccagctcctagtatcctctattctgctttctgtctccatgaatttgccttttctaggtatcttacataaatagaatcataaaatatttgtccctttgtgtctggtttcttttacttagaaatgttttcaggcttcatctatgttgtcaaatatatcagaatttcattcctttttaaggctggataatatccctaacagtgtgtgaggatctcagtttctccatttccttaccaacagttgtttttccttttaaaaaattatcatagccatcctaggatctgtctaattttgtcacataaggtgttactgtggaaaggagcacggatctacgcagaagtccaagcctcatcactaacagactaacagtgtgaggtggacaatcctggagctcttagtgcctcagtttctttctctgtaaagtggagctaataatgcctgcctggcaaagctgtataggtggagtgaagataatgatgcatataaaatactagtacagactctagaatgtggtagctattattttccacagaatgtaaacttaatggaggcagagatttggtctgttaggcacaccttagtatcccaacccctggagcagtgagtggcactcagtaggcactccaaaaacatctgcggaatgaatgaatgaactcttaacaagcagggctatgtggaagtgagttgtcatggatagtgaggaccctgttactggcagtgttcaagcgtgatctgcataaacactgagtggcgattatgtactgggccccgtggaataatagcaagatggaaacgcacccacctagccttcaaagagcaaaggctacagagttgtggggacttaagtcccccataacttatgatgcaagccatgcaggctcctggcagagtggggtccccagggaagatagccaggagggctaggggcttgagctggagcacccttggggcaggtggggccctgacccagtgaggccagcctggctgcggccacctaccctgtgccaggtgctgccagaccgcgacggaaagcgctgcatgttctgtgtgaagacagccaaccgcacgtatgagatgagcgcctcagacacgcgccagcgccaggagtggacagctggtgagtgctcgctaggtggcttgggtctgggtggtccttaggcgcctcatctgtgaaaagggggtgataatactttgtccagcgggaggttggagagtggactcgggaaactcctaaggcccctttcgggccgtgtgcgaggatcctactgacccgctcccgctcttcggcagccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggtggggttagctcccggcgccggggacgggaccggtgggctgggaggctggccaggggcggagcgccgggggcggggcctgggcagagggcggagctcctgggttgaggggcgtgcactggggtggagcttgaaatgagggattgttgggacagagtccgcgggtttgaaaaagagatttgggatggggcttccgccagggacagaacctggggctaggaaaggggtgtggggcgaggtccgagcccgtggatggatggggcctggttcggagaccttggctgtgggttggggcttgggcagaaggagccgttgaagaccgtgtgattggggattagactggaccaagtttggactagacttgaactaagtttacagtgaaaccagtttgagaggcaagcgggacgcgtatggaggcggactaggtgtgcagaggcaattagatttaggatttaagaaacctggatctggagtcagaaacacgtagattcaatcctagctctgcttcttacgagccccgtgatcccaggcaagttcattttactgagccttatcagtaaaatgctaatgctaatagaactttgctcacagaggtacggtgaggattaaatgaggaaacacttgtagtgtccagtaactttttgttgtaataattgtagttatagtcacatccttcctagcatcagccatgattataacatattattatatattataataattattaagttagtgctaggaaggagatgaccatatttttatatcttatttaattatataatgttgtttaattacatgttatataattatgattaaggttggtactaggaaggaaataacttgagcccgtttcccccacgtggcatctgttcaccgaccattatctgttccagtcaggctctcagaaaggggtcagatcaggaaaccccaacatgaaggagttccccagaccctcacccctaggcagcttagcaacatgcccaccccctcctcctccgcccccacgtgccccttttgacctggctcttggtccaccacctcccccctccacaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccaggtaggcctgaggaacctcttctggttctctcaccacccctcctggaacacaccccagttttcctgcttgctgtgcacctgcaaggtgccttggcactagaggctacacagtacacactcacccggcagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggtgaggcctggggtgggatggggtggaggctggcagggtgagctcattagggcacaggctctggagccaggctgccttccctcaaaccctggccctagcagctgctggctgtgtgactttggacaaatgcccaaacttcttggagttagtctctcacctgggaaactggtaatagcgttgttatgaagattaaatgagatgatacatgatacttagtacgtagtaagtgctgaagaaacatttgctgctatctttgttcacatcattattaatctggggaaaaatttttccttctacccttccaagcccctgtcttgctatccttgtactttggctctactccttggagctttaatctccataaattcaaacacagaaatatggaacatagaaagggaaaattcctccatgatcccccccacctcacaaccactgctaatggctccgtgaaatgttgaacagaggttcttggattaggtgctggaaaggtggtgtagtgcagtggcttagagctcaagtgtatccctgggcaagtcacttaacctcttttgaacttttttgttgttaacttctgctctggaagttaaataagataataaatatgcttagcacatcttagctgctcaataaacggaaactattattatggttacattttatcttttggaagtccatgagtcccatgaaattggaggcaaactctattcatgtatgtattaataactctatgagcatatatggtttttctctggggagatgatcagtagtcttggtcagattttaagcagcctgcgaacctgaaaagatcaagactccatgccatggatgatggttctgatcactccccactggccctgtccccacaggctgcccagagaaaactgcgccaggccagcaccaacgtgaaacactggaatgtccagatgaaccggctgatgcatccaattgagcctggaggtgagaaggaatagactctggagctttccctggagctgggagggagaaaggagggagaaaggtctccctgggagacctccagatctcccagggccagcaaaagcaggactggcagtcaggaggctcccctctcctctgagggctgaggcaaggcccctcgcctctcacctttgcatgcctttctccttacttgcctgccttctctctgccagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatgaattattggctcaggtctgtccatctctcctgccatttcctcccttcctccctcaagccccgttataggttccaaagagcagtaaaagtataataaagtggttaagaaagaccctgcagctagactgcctgggttctgaacctggctttgctacttactaactgattgactttggtcaattttctttatatctctgtgtttcagttcccacgttggtaaaatagagataatgactgtacttaccatatagggttatatgaggattaagtggcacacgagcaagcaccattattagaatcagccaaaagtgtttattgagtgtctactgcagttttccaggttatttaattctcatgacaactcttagagctggaaatcaccattggcattttacaaatggatgaattgaggttcagagagatttggcaactttaccaaagcctttcagacttgcttttcttcccatcatctctgactcgctgaccttgttagccaagacagagatctgggtatttaggaagattcatgtcctctctctcagccccctcatccaaaccccatcatcaaatccaatagactctctccttcctactctcctatctgtccctccttttccatccccatggctactgccatggctgaggcctttgtgttttctacctggttgttaacctttaactcctcctccgtcttgcccatctcaccaagtccaactgattggacttccttggttactctcagatccacacttttgaggccatgtctgtcatggctactgccttattctggctcttgtcacttcccaactagataagagcagtaaccaggtctccttgtcaacccctctccccattgccacctggataggatttctaaaatgcagatttgtccttcactcttcctaatttccagtcccttggtggtatcctagagttttgatatttaaattcacattcccatatgtggcagatgaggcccatggcgatctgtcccaggagggcctcctatgcctctgccttatagagctacttgcagctccctctaggcctcacactgacttcctttcccccatccttgtaacagccttcataactaaatgcttgagcccctcaagggcagggacatatcttcttgaactaagagccacggtgattggctcttagaaggcatgcaacaaatatttgtcaaatacatatatgaatgaataaattctgaagtgaataattcaggtgtcacaaagctaaaaagttatagagcagctgaaattcaagttcattcgttttccaggtccctacaagagacagggtctctacaaaactcggctggcctccaactcccgggctcaagcagttttcccgcctcagcttcccaaagtgctgggattataggcaggagccaatgcactctgccctcattcaacaaatgtttattaagctcttattatatgccagcttctggctatattgtacagaacaaaaacagagtccctgccttcctggagtttatgtgctatctgattttttgaaaccaagtctccaggctggagactgtgcctgatcagtctccaggctggagcacagtgcctgatcagtctccaggctggagcacagtgcctgatcagtctccaggctggagcacagtgcctgatcttggttcactgcaacctccacctcccaggttcagacgactctcctatctcaacctctggagtagctgggattacaggcgtgtgccaccacacctggcatttttttgttgttttgtacttttagtagagacatggtttcactacgttggtcaggctagtctcgaaatcctggcctcaagtgatctgcccgcctcagcctcccaaattgctgggattacaggtgtgagccactgcacctgatttactttgcaaatacactaaacctgattgcaaggaacttcattacagtctatttaaagtgtcgtgaaacaaagctgctaatataatgaggcagatttcaaggatgagcggtgaagctcaaagtgctgtaggaattcagagaaaaggaagttttaggtaggagctgggatttgggatggcctttactttttaataaaggcagctgggtgcagtggctcacacctgtaatcccagcactttgggaggccaaggtgggtggattgtttgagttcaggagtttgagaccagcctgggcaacatggcgaaaacccatctctacaaaaaatacaaaaaaaagttagccgggtgtggtagcagacacctgtagtcccagctacttaggaggctcaggtgggaggatcacctgagcccaggaggttgaagctgcagtgagctgtgatcgtgccactgcactccagactgggtgatagagtgagacactatctcaaaaaaaaaaaaaaaaaaaaaaagacagaaattgtatgcatcctatcctctgtaactattgctttttgttttttttttatttttttaatttaattttattttaaattttaatctatttatttattttgagactgggttatgagactggctaatttttgtatttttgtagagacaaggtttcaccatgttgcccaggctaatctcaaactcctgggcttaagtgatccacccacctcggcctcccaaagtgttgggattacaagcatgagccaccgcatctggctggtaactattatgttttaaactaatgatgaaaaatactatatgtcatcttaaaaatgtgcaaggtggctggatgcagtggctcatgcctgtaatcccagcattttgggaggccaaggtgggaggatcacttgaggccaggagttcaaagccagcctgggcaaaatagtgagccatgtctctacaaaaagtaaaaaaaaattaggtgtggagacatgtgcctagagtcccagctactggggaggccacggtgggaggatcccttgaggccaggagttggagaccagccttggcaacgtagtgagaccccatctctaccaaaaatttaaaaacaattttttttaattacctaggtgtggtgcatgcgaaggtcaaggctgcaatgagctatgatcatgccactgcacttcagcctaggctacagagtcagaatccatcttaaaaaaaaaaaaaagaaaaaaaatgtgcaagaggtccagggcccagatcaaaattgccaatccagaagaaggttcctctgtcaggcaagttactatctatcactagttctgctgccagtattagtcaggcctggtatctaatcaatgccaggcttttctctgagaagggaatggggtatggctagagcagtgtagattccctcataacccctttctgctgttttcttatgatctaactgtggaatttttggggtcagtgattccaggtttttttttgttgttgttgtttgtttgtttttgagacagagtttcgctcttgttgcccaggctggagtgcaatggtgcaatcttggctcactgcaacctccgcctcctaggttcaagcaattctcctgcctcagcctcccgagtagctgggattacaggtgtgcaccaccacatccagctaactttttggattattagtagagatgggatttcaccatgttgccaggctggtcttgaactcctgacctcaggtgatgtgcccgcctcagcctcccaaagtgctaggattacaggtgttgagccaccacgcccggcctgattccacgttgtaaataatttgtaagtattcagtttctacatctttatcatctgctaagaattttaaaataatattctctgttcagctgtcaatgttgaaacccatatttagtattacaagcttttccctggttttagctttgcttggagttttttgacccatgaatgttatttctgtttgtcaataagaaatgtaagactggaatgttaataaatttcagtttagttctataatgtcaagaatttaaaaatttaaaaaattactgcaggaaaaagatagctataaaaagaaaaaaaaaaaaaggcccagggctgggcacggtgcctcacgcctataatcccagcactttgggaagccaaggtgggtggatcatgaggtcaggagttcaagaccagcctggccaacaggatgaaaccccgtctctactaaaaatacaaaaattagctgggcatggtggcacgtgcctg

SEQ ID NO: 783 - DNA, 2739 bp, Homo sapiens
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaagaaaaaaaaaa

SEQ ID NO: 784 - DNA, 545 bp, Homo sapiens
  misc_feature 232, 531: n = A,T,C or G
ttttttctttactgggtttcatttaatgctgaaatcagacaatgattagaacatgaaactttgtttgaaaaagtatattcaataaattttgtatttaaaacagagctcttgacctataaagtataaaaagtaattacaatgaaatattcttcagtaaatctgacactttgggattccaggcaaaaggatcgcttgggtgccaagagttcaagaccagcctggtcaacatagngaggaatctatctcctagtccaatgtgaataacaaaatgaagaatatcaggatgattcgagaccaggaatactacagatgtccaacacttccacctggaatccccaaagaggcccgcttttagcctccacactggttggtgacctgcctctgcagttcactctgctgcttcagatgaaaattttcaggtctgtctgccactgtagtgaagcactgctttgggagtgtctgtggagaaactttttaaaggacatagttgaaatattgtgctacaaaccaattcttgaacaccactcattntgtcctacctctct

SEQ ID NO: 785 - DNA, 1701 bp, Homo sapiens
gagcaccgcacactcacttcaccctggttcaacacccccacgaggttgaccccgtcattatgttagagattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaacatgatcacagagggagcgcaggcccctcgattgttgctgccgccgctgctcctgctgctcaccctgccagccacaggctcagaccccgtgctctgcttcacccagtatgaagaatcctccggcaagtgcaagggcctcctggggggtggtgtcagcgtggaagactgctgtctcaacactgcctttgcctaccagaaacgtagtggtgggctctgtcagccttgcaggtccccacgatggtccctgtggtccacatgggccccctgttcggtgacgtgctctgagggctcccagctgcggtaccggcgctgtgtgggctggaatgggcagtgctctggaaaggtggcacctgggaccctggagtggcagctccaggcctgtgaggaccagcagtgctgtcctgagatgggcggctggtctggctgggggccctgggagccttgctctgtcacctgctccaaagggacccggacccgcaggcgagcctgtaatcaccctgctcccaagtgtgggggccactgcccaggacaggcacaggaatcagaggcctgtgacacccagcaggtctgccccacacacggggcctgggccacctggggcccctggaccccctgctcagcctcctgccacggtggaccccacgaacctaaggagacacgaagccgcaagtgttctgcacctgagccctcccagaaacctcctgggaagccctgcccggggctagcctacgagcagcggaggtgcaccggcctgccaccctgcccagtggctgggggctgggggccttggggccctgtgagcccctgccctgtgacctgtggcctgggccagaccatggaacaacggacgtgcaatcaccctgtgccccagcatgggggccccttctgtgctggcgatgccacccggacccacatctgcaacacagctgtgccctgccctgtggatggggagtgggactcgtggggggagtggagcccctgtatccgacggaacatgaagtccatcagctgtcaagaaatcccgggccagcagtcacgcgggaggacctgcaggggccgcaagtttgacggacatcgatgtgccgggcaacagcaggatatccggcactgctacagcatccagcactgccccttgaaaggatcatggtcagagtggagtacctgggggctgtgcatgcccccctgtggacctaatcctacccgtgcccgccagcgcctctgcacacccttgctccccaagtacccgcccaccgtttccatggtcgaaggtcagggcgagaagaacgtgaccttctgggggagaccgctgccacggtgtgaggagctacaagggcagaagctggtggtggaggagaaacgaccatgtctacacgtgcctgcttgcaaagaccctgaggaagaggaactctaacacttctctcctccactctgagccccctgaccttccaaacctcaataaa

SEQ ID NO: 786 - DNA, 3543 bp, Homo sapiens
tgcgtgtcgttccccttctctgggatgggaggcagctgccacgggcctctgaaagaggtgcctggaggcaaagacattgcaagtccgaacttcgttctgggccaagctgtgtgcccacaggagcgggcaaacggggctgagaagcagcaagaaggacaagctcgggtaggagaaaaggggcagaagaagagtgacactgtggcttccttgatgttgcagcacccctctacggcccctcccaatccacagagcctctgaccagcaccagtcttgctgcctgtgctgggggcacttggaacattggttagcaggagcaacaggcctggcactgccagctaggttcagggaagagagaaatgggctgagctgctgctcctggtactactgggccatggatgaaggcaccagactagaagtccagagccctagccaggggcggcaggagggaagactaccacttattgtgtacctattctgtgcctagccccgcaggaggcacttgaatgtttctcatttagtcacatacatttattgagcacctaccacatgccaggcattgtcctgatgggatgcagtggtgagcaaggttcctgctctcataacaaccctgggaggtaggccctattgtcatccccattttacagatgagaaaatcaaggctcaatacagtttcatgatttatcacagctagtgagtgtggaggagggattctgggccctgacctaactcgtaagccttcgtttttcaggctacctttcatggccatgaccactcttctaatagcccccaggcttagccttgcctcctgggcagggctatggctgccccttttgttggagtgttggagaccctgcctctacttgtttccacccatccctccaagccagagcttagccatataacaagagctcggtaatgaaccctcctgggtgcaatgctgggtggtgacccagagtcaccttctccatccccgttgccctgacagccactcttttggggcaggcagatgaagagactgaggttccaagagtgtctgtcacttgcccaatatggagaggtacaaccagacagtcccaagaggccctggtaccttgccctggctctcaagggaggaaccagctgagggtagcatgtcctggccccaaagctgactgctaccatgctgtcccatgtctctacccactgttcccagtgaagactgaggccctatcccctgccaggggccaggcaacagggacacctttcttcttgcttctgggccaacagccacagccctgggaggcagagcccagacatgcctggtgacttcagggctgatgctccctccttcctcccaccccgtcgctcactccccatgttgttccggatggagtggggctgtgccctgacaggcagccagtccgctgtctggccatcatctcctgtctctgaggaaattcccagaatgcaccctggaaggaacggaaaaaagcagcaaagaaagtgagaaagaaaaagcaacagagaacagacagaaacaaccaaatttgatgccaagaggctgagaagtgcagaagcgggtggcaggggtccccaggaggttgatttgtccctctcgtggtggggtcaccagagcctggagtgggagtgaagccttgaggctctggccacctctcccttgccaactccatgctaccccctagtggcctcagtgtcagctgcaggaccaggactggggatgtcggaggggacctgtccgggcggcagggagccccacttattgctttcctaacgttcctctgcccctctctctgtctgtttccctaggcctctgcgggagaagatgaagccggaaaggaggagacccaagggcagggggaagaggaggagagagaagcagagacccacagactgccacctgtgagtgcgcggggtcccagggatggcgaggaggctgggcccgaggggagccccgccttgccgccagggttaggttggggagggggagagggcaggactgaggccagtcttgggggcagaacgggagctgcacctcctcaagactctagggcccaggaagcatcagtggaccttggtttttgtcccggcttagccctaggtttccattgaccttcaacaaatcatttcacctttgtcagcctagcttttctctgtgtagaatgaggggcaggaggtccagcaaacattcagtcactctacaaacatttactgagcacttactgtgtgtcaggtacatctgtgagcaaacaaacaggattcctgcacattagtgtttaccttttagtgattaaaagtctgtcatcagctgagacgttatctggggccacttcctagtagccccggggaacatgtgcccctcgccactgtctcccaggagtatttttgcctgtgggtccccttgctgcttctaacccacttcgtaccttgtgggcagcagaatggagccccaggcctgagtgtggctgggagagaaggatgagaggagggaaaacccaaatctgtgagagtaaatagaaaaaataaaatatttcacgtgcacagtcaatcagtcactgaagagaggtggctctccttcaggggctaagcctcccccacgcacgtgactccaggaagtcatttcgtgctatggagtggagttgacccaagccctgaccccatgagccccactccatgaagacagggatcctggggactgcgccccctaggggtttatgctttcatctcttttctgggcccgcgcggcaatttgggaaacaagctggcagggaagtccatccaggcccgagttacccgccggcagccggaggcagaaagtgtcccgtggctcctgttcccaaggcagcagtcttcagacatttcactcgggaatctcctgaaagaatttcaaaagtggccgggcgcagtggctaacacctgtaatcccagcactttgggaggccgaagtgggtagatcacttgaggtcagaagttcgaggccagcctgaccaacacggtgaaaccacatctctactaaaaatacaaaattagctgggcgtgttggtgcatgcctgtaatctcagctacttgggaggctgaggcaggagaatcgcttgaacccgggaggcggaggttgcagtgagccgagatcacgccactgcactccagcctgggtgacagagcaagactccgtctcaaaaaaaaaaaagaattccaaaagcccatgtgctcccttgcccattcttaagttgacattgaacattttcatcagaattataagtcaagccaggctcagtacctcatgcctgtaattctagcactttgggaggccgaggcgagtggatcgcttgaggccaggagttcaagcctagccggggcaacatggcgaaacctcgtctctacaaaaaaaatacaaaaactagctggacgtggtgccatgtgcctatagtcccaactactcaggaggctgaggtggaatgatcacctgagcctgggaggtcaaggctgcagtgagccgagatagatccactgcacctcagcctgggtgacagagtaagaacctgtctc

SEQ ID NO: 787 - DNA, 635 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatca

SEQ ID NO: 788 - DNA, 1628 bp, Homo sapiens
gagcgcggcccctgggttcgaacacggcacccgcactgcgcgtcatggtgctggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgacgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagtgggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtatttttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactg

SEQ ID NO: 789 - DNA, 1074 bp, Homo sapiens
gtaaagctcccatcctgccctgaccctgccatgggcaccagcctcctctgctggatggccctgtgtctcctgggggcagatcacgcagatactggagtctcccagaaccccagacacaacatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagcagggttgaatcagccccagcattttggtgatgggactcgactctccatcctagaggacctgaacaaggtgttcccacccgaggtcgctgtgtttgagccatcagaagcagagatctcccacacccaaaaggccacactggtgtgcctggccacaggtatcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccatgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaata

SEQ ID NO: 790 - DNA, 1492 bp, Homo sapiens
caaagtgggcagcccacgaaagagagtcagaggagagtgcaaggtccccacccaccatgggctcacctgggcccagaggaatccgttatttctaggtcaggcgcaaacagttccttggtttggagcaggagcccgggtctggacgatgggtgaggggaggtgattttggagcagggtctctgggcagggaggggccaggtttgctcagggcagaggcagcagtttagcctctgctggtggcagctctccccactccctgcaaggctgcggtgatcccctgtgaaaatgcattgtccccctcctccagggctccaaggtgctgtccccaagcagtcatcaccccagacctgggtctctgagtctcagtgtgggtggggctgactctgccacccagggctccagctttgtgtcagacccacgggagtttcactcctgactccaccctggtactcctccacctttctaacctcggttttcctcatctggaaaatggggacagggacacctacagcagggggttccatggtgtgctctttccccttggctggtcacaagtaactccggtgactgcagggccaaggtgcatgaagcaacaaagctgagtccagcccgtccttcagtcccacatgcagctgctgggacctctgggaagtcactgagacaaagccgcatggaggagcggggagatatctggctggccttgggagggttggccttggtaacctgtggggaggcgaattccaggcccctctgggtttcctcgtgggtccattctctcccccgagctctggcttgagcacctggctagagcccctctccagggagagctagggacccatgtccagcccaggaggaatggggggcactggggcatacattcttctttttctgcctcattctctgttcccctagaccgggagacaaaggactggatttgaatcctgtctttgcctttcaccagatataaggcattgggcaaggtattgaatctctccaagcctcagttttctcatctgtaaaatgggagtggctgggtgcagtggctcacacctgtaatcccagcactttgggaggtcgaggcggatggaccacctgaggtcgggagttcgagaccagcctggccaacgtggtgaaaccccgtctctactaaaaatacaaaaaattagccgagcgtcgtggcaggcacctgtaatcttagctactcgggaggctgaggcagaagaatcacttgaacctgggaagaggaggttttggtgagctgggatcgtgccactgcactccaaccttggtgacagagcaaaattccatctcaaaaaaaaacaaaactggtgtggtagtgtgcacttgtagtcccagctactcgggaggctgaggcaggaggatcacttgaacccaggaggttgaggctgcagtgagccaaagtcatgccactccacttcaacctgagtgacagagagagaccctgtctcaaaaataaaaaaaaaaaaaaaaa

SEQ ID NO: 791 - DNA, 3322 bp, Homo sapiens
tccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcagcctccgcctcccagattaaagtgattctcctgcctcaacctcctgagtggctgggattgcaggcatgcgccaccatgccgggcgaattttgtatttttaatagagacggggtttctctgtgttggtcaggctggtctcaaactcccaacctcaggtgatccgcccacctcggcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatggtgaggccccgtctctactaaaaaaaaaaaaaaaaaa

SEQ ID NO: 792 - DNA, 1450 bp, Homo sapiens
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtccccgccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctcttgattcgtaggaattgaggagtgtctccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcaaaaaaaaaaaaaaaaaaaaaaaaaaaaaaaaaaaaaaaaaaa

SEQ ID NO: 793 - DNA, 591 bp, Homo sapiens
cagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggactc

SEQ ID NO: 794 - DNA, 2436 bp, Homo sapiens
cttgacatttccccagtccctgagctcatcttgaatttaaaaggaggctatctggaggctgggtggggactgagtcaccacctcccgtggctttctcatcctgagcagcaaccagacacacccagagggccactgctggagacctgcagattgtaaatgccacacaggctttcttcccagaagctcagatgggctcttgcgggaaggctgtcatcgtggttctgtatgtatttcttccttcccctagccactttgagaagttgttgcctgtcctttcccgcttcagcctttattaatgctgtcctcttcccctatagtgccctctcttcccctagaggcccacactgtcaaatgccacctcccccaggaagtttgtccttgctggctctggagtcccagcaggactcctgaggatgcttacggcatgaccttggcaggtcacgccacctttctgtgcctcagttttctcatatataaaatttgggtttcttgtctttataaagctccatccctagacactctcatttggcaggtcttggggcaggaatcacatgcccctaggtttttaaaccagctctctagaggatgctggtgctgagagcctgtcggctgcaacctgggaaaagctgaactgagaggaccctggtttgcatgacagcctagcttgttgctgtgtgaccttggattagtcagctttctgtacctccgttttcctccctatcagattggggtggaaatgagaactcgtgtagtaacagcccctcaataaatggcagtcatcaccatcatcagctttgttttgtgtggggattggtggttttcagaagcaagtcacctttcccctacttggtcctggcagcaggcactgtcaagtcagactgggccagggtgcaggctgtggaattgaacacctgagcaggaatgaagtcagcctgtctttaaacagccccatcgagggagaggagcttgcccaagggtaaacagctggctggctcctgccagagctgggacagggatccaggactaggacattacagtccagggctctttaacctcctccccactacctggttattcgagaatgcacctgcccttccaatagagcagggagacggctgtttcttaattcaggccccaatcctgcttgttctttgttagtccgtttgtaaagatagatgggcgtgcccatcgggatgtctgtgcagggggacagttggattttccatgttccatcccattgttgtttaagggtgggccctgcttggacagtggcacttggaataaagtcactttgtagttgtgagccttggctgcttttcctgcttcccctgtagagtaggggaacaaagacctcagccgagagaggttctgcagagagctggggtttgctgtcaaggagcttaggatgtcctagaactttggtgcagggaatgagatcagctgttcaagcgccttgtcttacagatgaagagatgaggcccagaagggccagggacccacagaggtttgagccaggacttctgggtcctgttccatggcactgcctttgaagaagtcactgtcatgctgttatcacctgcccctggtgtataatgacaatctctaacatcctttgacctttttactgtgtacgctgtgcttggtgctttacttcagctacttgcagtggaaaagaagaagggcttggtgcctggcctggaagtgaggggtgcaggatcccagttcccacatctcacccacttttagggatgtcactttcctttgggcttcagcttcctaatccataaaatgggaataacattccttatcctaagactgattctgaaatcatggaatccctcaagaattgtgtgagcagcggctcactcctgtaatcctagcactttgggaggccaaggcaggcaggtcgcttgagctcaggagttcaagaccagcttgggcaacaagacaaaaccctgttgctccaaaaaatacaaaaattagctgggtgtggtggcatgcgcttgtattcccagctacttggaggaggctgaggcaggaggacagcttgaatccagaaggtcaggaggtcgagactgcagtgagctgagatcatgccactgcactccagcctgggtaacaaaatgagaccctgtcgaccgggcgcgctggctcacgcctgtaatcccaacactttgggaggccgaggcgggcagatcactggaggtcaggggttcgacatcagcctggccaacatggtgaaaccccgtctctactgaaaatacaaaaattagctgggtgtggtggcacacgcctgtaatcccagctacttgggaggctgacgcaggagaatcatttgaacctgggaagcggaggttgcagtgagctgagattgcaccattgcactccagcatgggtgacaaaagcaaaactctgtctcaaaaaaaaaaaaaaaaa

SEQ ID NO: 795 - DNA, 2098 bp, Homo sapiens
taaaaaatgtcatcacttgccaagcctggtggctcatgcctgtaatcccagcactttgtgaggctgaggcaggaggattacttgagtccaaaagattgaagctgcagtgagctgtgattgggccactgccctctagcctgggcaacagagcaagaccctattcaacaataacaaaaaaaggaattaggtgatgggaaatgcctaccatttgaatctataaagataagcaaggcagggtgcagtggctcacgcctataatgccaacattttgggaggctgagacaggaggatcgcttgagctccagagttcaagaccagcctgggcaacatagtgagatctagtctctacaaaaataaacaaatttagctgggtgtggtggtgcgtgcctgtagtctcagctacatgggaggctgaggtgggaggattgagtgagctcaggaggttgagactgcaatgagccatgattacgccactgcactgcggcctaggtgacagcaaaacctgtctcaaaaaagagagagagagagataagcaagagttactcatgatgcttggacttgggggaagatgccaactctggcacatgtcagttactacataaaaagtcaagtgcaatgtcaaatccagagcatcaagaggaaaaaaagttcagttcccaagagaacatggatagcttaataatgtaaaacttggccgggcagggtggctcacgcctgtaatcccagctactagggaggctggggccaggctggtcttgcacacctgacctcaggcgatctgcctgcctccacctcccaaagtgctgggattgcaggcttgagccaccgtgcccagccctatgaattatttcaaatgcgttagatccacctaatcaaaattctgtcattcaacatataattttgagtgccaactatgtctcaaggtcagtgttcagccctacagtaaacaacatgaacagagctgctgccttcacagaacctccatctaaggagcaggtgaatataccaccaggccgtaattggttgcttagctccaaaatagcgaatttagggtcaattaagataataatctactaactgtaatgacatctctagagtattgtgtcttttaaagtacagttatagcctgggcaacgtggggaaaccccgtctctacaaaaaaaaaaattttttttctttgagacagtcttattttttcacccaggctggagtgcagtggggcgatctcagctcactgcaacctcaaactcccgggttcaagcaattctcatgtctcagcctcctgagtagctgggattacaggcgtacaccaccacgcatggctaatttttgcaattttagtaaagacgggattttgccatgttggccaggctggtctcgaactcctggcctcaagtgatctgcctgccttggcctcccatagtgctgggattacaggtgtgagccaccgcacctgacccctcctgtctctcttaacacacattgcctccttatagaggttcaggcaccatgctgagcctgggaggtaatacaaaaatgaatgagtggaccttgtgggttccatgctagttaaagacaccctatgagaccagcctggccaacatggtgaaaccttgtgtctactaaaaatacagaaaatagccgggcatggtggtgtgtgcctgtaattccagctactggggatgctgaggcaggagaatcgcttgaacccaggaggtggaggttgcagtgagctgagatcacaccactgcactccagcttgggcgatagagtgagactccatctcagaaaaaaaagacaccccgggccaggcaaggtgggtcacacctgtaatcccagcactttggggaacaaggtgggagaatcacttgagtccggcagtttgagaccagcctggccaacataatgagaccgcatcttcacaaaaaatatgttttaaaaagctgggcatggtgaagtgtgcctgtggtcccagctacttgggaggctgaagtgggagtattgcctgagcccaggagttcgaggctgcaggctgcagtgaactgtgatcacaccactgcactccagtgtgggtgacagagggagaccctgactcatt

SEQ ID NO: 796 - DNA, 744 bp, Homo sapiens
  misc_feature 524: n = A,T,C or G
aggtctgtttgatgatcttagctcttgacgtcagcactcagactcttagggtcacccaatccatgtgccgctcccagcaacagggaaggcatttctctatcagtttgttggtaaatgattattgacaaacaatgtgctgggaatgtggagtgatttgagtagatctggcctctattctcatggagcttcctttctagaggggaaggcagatgatggatggataaatataaatgattctaataggttggtgcagcagtcattaaaagtaatggcaaaaaaaaaccaaaagaaacggggaggagccgttgctgccgttcattgatagtaatggcaaaacccgcgacgacttgtgcgccaacctgacccagtaaccacgggtgtgcaaatgtggcgatgggcaagttccgagtgctaggagagcatctagcttcccggagtcaggagacgggggttggcaacctaaccaaggttaagtccaagtgaggggggtgcgcagggaagcggttatttattttttttttttnatttttattttttttttttttttttttttttttattattttattattatttttttttataatttattttttataatatttttatataatttaattattttttatttattttttttttttataaatatttatattatatttttatttttaatattttttttatttatatattaattaatatttttttatttattaattatttttatatttatattttttcc

SEQ ID NO: 797 - DNA, 494 bp, Homo sapiens
ggaaactgaggctcaggagagaggcgctccaggccgatgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagccctt

SEQ ID NO: 798 - DNA, 2185 bp, Homo sapiens
aatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 799 - DNA, 1653 bp, Homo sapiens
gcttttttttttttttttttttttttttagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgttttttttttttttttttttagacagagtttcgctcttgttgtccaggctggagtacaatggcttgatcttggctcactgcaatctctgcctcgcaggttcaagcgattctcctgcctcagcctctggagtggctgggattacaggcgcccaccatcacgcccggccaattttttgtatttttagtagagacagggtttcaccatgttggccaggctggcctcgaactcttgacctcaggtgatccacctgccttggcctcccaatgtactgagattacaggcatgagccaccacgcccggccaaaaacatttaaaaaatgactgtccctgctcaaatactgcagtaggaaatgtaatttgacatatatcacttccagaaaaaaactttaaatctttctataaaatgaatttgatacatcatcagcatgaagtgaagttaaaatctcttacaaagtaaattcaggtatatcaacaatgagatccaaaagtatcggttcaagatcaaagactcatatgaggtaaaggcaaataaagcccctcatgctttcagacatttacttgttatccttaaaatgattattgttctaaggtgcaaatcttatcattcagtgacctatttgctatttggctgtttatctcctttaaataaaataccatacaggttataatgtacattttaaaatcaaatatgaaagtacacatatgtgaacaagacattaatttaaatatcaattatattcataatacagaagtctaagaatgctatttggtcatttcaattagatgctgatatatttggtcaagaaaacccacattcctatcagcctaaggcaaatagtaaatgcctctatttttattaagtggactataaacagtagacattattgtttgatactactggaatgctctcaattagaacgtacactgataacaaatatgtctttctaatctgggtgataacctcaatgattacatggaaatctacaagtaacagtctataacttaaagcagtagagcacctggtaattgtcatacagtgcctctctatgaatttagaacattctacttacattggcagtggagagaaaagaccccttcacactgagacttcctgtgcaccgcgcctgccgcctgcctcagcttaggacatggtacagtcttctttgcttttgcccttctcattccctcctctggtatcttctctgctttctggattgaagtgccctggctctcttcctggtgccgacaagtcattgttctctaggctattgctgtctaaagctttcctgacggtctgacttggatgttctgacatctcacacctttctgtcttcctcttctcaccctcctccctccccttagccatcacttctgggaagtaaagaacttgacttagtgccggaaaaaaaaaaaaaaaaaaaaaaaaaaaaaaaaaaaaaaaaaaaaaaaaaaaaaaaaaaaaaaaaaa

SEQ ID NO: 800 - DNA, 482 bp, Homo sapiens
  misc_feature 365, 406, 439, 474: n = A,T,C or G
ttttttttttttgatgtataccaaatttttattgttttagaatttacaaattctttaaaaatgctttttaaggcatttacctatttactatattatcaatttatctacataaatcacattcattatatttttatttttttagacacagggtctcactcagtcgcacaggctggagttcagtggtgtgaccacaggctcactgcaacccaggaaccactgggttcaactgatcctcccaactcaggcctcttaagtaactagggactacagggcacacgacaccatcggccaggctaatttttatttttttgtaaagacaggggtctcggctttgttgcccggggtgggtcttcaaactccggggncttcatggcaatcctcccactttgggccttcccaaagtgtngggggattacagggcatggaaccactggcccantgcctccaggccttttttagggttttttagggccntatttttt

SEQ ID NO: 801 - DNA, 7002 bp, Homo sapiens
  misc_feature 5108, 5114, 5186: n = A,T,C or G
gaattccgtctgagtggcgctcgcggcggccgcgccagtcgcgtcccccaccccaacccccaccccaacggccgcacgcgcgcggcggacggacgggcgcggcgcgtcctcgctcccgctcccgtcccggctggggcgcgtggccgtgtccgccgcgtgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtgggtacggctatcctccttccttagcggcccaaggcacgggtttggagagcggggtcacaggcacgcacgggaagggcggggatttgttgacgccgggccctctgactccgagctccccgcttcccaagcctgtttttagtctttgcccccagagcacttgtccctcggggcagtatcagcctcaaaaggccacctgccgagaaggctgcagcggcatttgtacttgggctagttctgggcttccagggagacaagggttggaagtgggaatgtgacaaaggaaaagggtttgggcttcctttctacgtgtacttgtacaggccctgggtagatgtgccgccaccgtagcttctggaaaaaagtagggaaaacgatgagtaagtgcaaatgaacatggactgtgttcctcatcgggtttgaatctcagattgctgatgggaaattcccgccagcgggaagttaggctccggttttagacgttgaatttttttttctctactttttttttaattggaggagacttttgcagaaagaccttgagaagattcactttatagttgaagggaatgaggtgcaaagcgacgaatttaagatctcactagcatctgtgggttaaaatacggaattggaatagaaaggttggcgcccagttacagtatacatttggacctctgtggagcgtgtcatgctggatgaattactggtgttggagatgtgttggaaaaaacaactgtgacagtcgagatctgtggatgaaagtttgtgtacactccgtttatttagcatttactctgctgggttcttgtgtatatgcagaaacaagatgcttttcttcagggactggagcttatatttttctagtagttaccatcttttagattatttaaaagccaacatactccttggcttagtgaaataaatcttctatgttatagaaacacttctataaacataaagatttctataatcgtgttctggaaaccctttctataaacatgtttctataacagtattataataatctataacagtattataataatgttccaagtaacatttacttggaactttgctggtgtggcgattccggttacttgcccttacagactggttactatgaatagcatttaactagactaaagttgagcaatttaagttgtcaaatgaaaacactagaatgacctacatttaaactgtttaagcttgagtccagctaattttattactgcttgaggcaaaatagaatgaaattaccttacacattattgagggaaaatttcgttagtttctacttaaaatattaaaaaaatacagttcttggcctcaggcaaatggttatcacttgggcaggaacatgaaaattacgtgattatttcacaaactggtgctctaactgattacttgtgcatttatcaggaacaagtgaattgaagcaaattgtggtaatgtaaggcttggcaaggctgccctacatccctaccaagtcatacgtcagttttgttggagctgcttaccggtacaaaagtctaagcttttgtacctcttacaggtagaaaagtagagagttctttgtttaactcagtttgctgttcctgagctgacactgcaccaggggaacattaggagattttggtaatgtttgtttgtgacctacttagagcagtttttgttttgtaacttatggtttttttttttcccactcgttctagtattttgcatagaaagtgaacggcagaaggcagttttaagtttttgtaaaagtttgtgaattttatatcgtccttaggactgatggggctagtgttaaaagataaaatttaacataaagcttacatttgtgactaaagccaattttatattttttttctttatttttgtcagtctgataaaactgcccacttggtcttttaacattttgcaaattgattttttttttaactttcagaatttaaataggcattgtatgtttgtttaattatattgtgctttggcttccttggacgaaactattactgactttacaaagaagaatggataattgtggaagtaggtaggtcaaaaaaaaaaaaggaaagcctcgcccgccccccagtaatttgtcaaaagcaagtgggaaaaatctctggtagtgcagtactgcccttccagtactccagtacaagccctggagttgaatttagattcagcaactattatcttacatgtagttggtgatcacaatgtggtggcacactaggtttataattttatatctcagaaatcagctatttacttttttttaaaaaagtattcttggacatcctgtctgtctttagttgggaaggtcaagttgcaagccaggtgatagggttaagagtaggaataattcacacacacgaatagtgtcttaatattctgtcttacaaggtggaaagcaatttcaaaaaaattgcccttacagcctgtagcttagtaaataaggtctttaggcgactttgtgatagagtccctcttctgtcaggtggccagtctgtcatgtaataagctcttggtatgtgtgttgtatcttaggtacttaatcaaaagtaaagattaaagatgattgacagaaatttggcttcctggatggtatacacatctacttagtagggatgtaatctttggtggctattaacttcactggctgtataaagcatcattatgtatttgtgtaaccttttgcatatttagagagtgctttcacacatctttggtattaccatacttttactaaaaagtgaattggagctctgaaaccgaattgtcaaaactattttgaaaagcatgtggtacctaatagggtactatagccagcttatttccttaattgaaaaatcttagagggattttgaatctggaatgtatgaatgtgacacctgcctgcccttgccagttctcccatatgctgtttatgcaaagccatagcgtgtgcttaagtacacccttgtttctgcactgaggttgcctagatttccctggagtgtatccacctgtcttgatctgtttaagaattttgcggatgagcattagtattaactgtaacatatcttttcacgtgatgagaaagaacaaagatttttttaaattgtgaacctgagtaggttttaactttggagtggggaagggatacactaagataaaagatagttgttaagtattctgattcctgaagttttttttctttcaggaaaacggtatttttgagataaagtaagatttgtggaagagttgcaatagagaggtcttgaatacccattatccactgttaacatcttatgtaatccaagtacatttaacagaactgagaaattaacatcgataaaatactgttaatgaaagactttatttggatttccttagtttttctactaatgtcctttttctgttctaggatccagtccaagatgccacattgtatgtagtctcctgatctgtgtcagtttctgtctttccttttgtctttcgtgaccatgacacttgatctcatttggatttgatgttaaggattagactgaagttacagatttttgggggaagaataccacagaaattacccttatcacatcagattgggggtccataatatataactggttgaatttaacctgatgatttggttcaggtggtatctgtcaggttagtgtttttttcccctttagatactattccttagatgctagtcaccaagtccagctcacactcaaggagagaggggaattaggctctactttctagagggaggagaatgtgaatttgtggaagtatattaaagctactgttattattttgggggagatgcttcgaagccatggaaataaagttcccctccttaattttagcattttaatggatctcgtctgcagctattattacttcggggttctaatggtgattttttttattttcctcattccttctacagtataaattttctgtgaggaagatttgtgtattcttcatgttttttctttttttcatttatatcactatagaccacggatattaattttattctttgggttgtaatccacaattatccttgctgatgtttacttatttttgattattatttattttatatttttataaaatatcgtccaggctgtctcacactcctgggctcaagcaatcctcttgtcttggcctctcaaagtgctgggattacaggtgtgagccactgtgctggccacagtttattttgttgttcatgttgttccagcttttttttttttttttggctcctttctccttttgacacttccctatcttatctgttttttaaaagcatgttttttctttcattaattaccaggtatttcaggctcatcttgcattttgcctgtctcaggtccagaatcaaccatttctccaaggaggcgtcaggaagaattgtgaagggaggtgacaggtggtaaatgcgaagagtttggaaaaatagattgacagtaggcccagtgatgttgatacttttcttgctctgagcacagatgttggcttctgtattcatgttactccagttctggnaaaagnttttgtttctaaattcccacgatttagagaaccagatatcaaatgtttgaatacatgacataatcctgaaanaaaatttacaaaaatttaatatattctcaagttagtacacacaaacacttgctgtttttccttggtgtttttgacaacttttttaaagtaaaaagaccacttaaatactatcgtactcagaattaacatttgacattttgcattgccctctaagactcctttttttctatacgggcttccattcccttccttccagggatctttttcacatctttccaggctgttttattgatggggaatttttaaaaatagctttattgaggtataattgacaataaactgcatgtttttaaaatgtactgcctgataatttcagacaccttttgtaatcccagcttctcaaaagactgaggcagcagagaggattacttgagcccagatgtttgagctgcagctgcagtgacctatggtcatgctacgcactccagcctgggcgacacaggagactcttaaaagaaggtatacccatgaaaaccatcaccacaatcaagattgtgaacctatccattacccccaaaagttttctcatgtcccttttccctctttcttgcttgttccttctacccttctccctgcaggaaatccttgatctttttatcactgtagattactttgcgttttttagaatttttttgtaaatacattatgttctttttttaattgctcagtgctagtctgttgtgtaggcatatcacaattttttggtttacctgttggtgggcattgaaaaacggcaaaagctgtgtgtttccagctttttgactgttacaaaataaagcttctgaactttgtgtacaagtctttgtatgggtatacgcctttatttctcttgggtaaatgcttaataggggaatgtttagatcatgtagtagatgtatgcctaacttttaaagaaactccctgttttccacagtggttgtaccattttacattgccaccagcgatgtttggggggttccagttctgccagtatgttggctaacagtgtgtatggtcagtctttttaattttagtcattgtgacaggtgtttagtggtacctcacaggttttaatttgcatttctgtaattgctagtgatcagcatttttcatttggcattcatataatttctttggcgaaatatctttaagtcttttgctcatattttatgggattggttacttaattattaatttttttgttttgagacagtgtttcgctcttgttgcccgggctggagtgcagtggcgccatctctgctcactacaacctctgcctcctgggtttaggtgattctcctgtctcagcctcctgagtagctgggattacaggtatccaccaccacacccggctaatttttgtatttttagtagagatggggtttcaccatgttggccaagctagtctcgaactactgacttcgggtgatctgccctcctcggcctcccaaagtgctgggattacaggcatgagagtactttatatattctggatagaggtattttaaaaattagagatatgggtcaggcgcagtggctcacacctgtaatcccagcactttgggaggccgaggcaggtggatcacttgaggccaggggttcgagaccagcctgggcaacatagtgagaccttgttgctactaaaaatttaaaaaattagccaggcatggtagtgtgcgcctgtagccccagctactcgggagggtgaggtgggaagatcacttgagcccaggagttagaggctgcagtgagccatgatcacaccactgcactccagcctgggtgacagagtgaaaccctatcaaaaaaaaaaaaaaaaaaaaaaaaaaaggaattc

SEQ ID NO: 802 - DNA, 1940 bp, Homo sapiens
cctactggtagatcttcacagactggatgttaagcaagtggaaaggcagaacagcctccactcgcggtgcacggggaagagtgggcggcggacgtggttttgggcctgggacccaggtgttcctctaggcccagggcgggcatcgctgcccatccgtcccacaggtggttctgaggcgtctctcaacagccatatggcggacaccagaacccgggtgtaacagtgacccgtttctgtgtgggtccccactcccagggagggcaggagagcgccgggggcgtaacccccctcccccacgctggcaccagagtgtgagcagaatcggcttaaggcagctcccagtccccatcgcccccaaggtcgaaagaatcgggacaggaaatgggtcgggggaccgagtttgggccggaatgttcagagcgtgtccgtcctgctctttaaagcccctctctccatcccagaaccaaagccgggcgcccccagcgctcgctgcggtctcgcgcccgggtaacggccgatggccgcccccgccccagccgcagccggggaggaaatcccgcgcctcggaagaggcgcttcgggctcgggcgggttccggaagccgaggggccgggagtaggtgggcgcataggggctcctgggaggcgggaccaagacgcgcgttaccgggaggccaggcccggcgctgcaccctccgcggcccggggcctgaggccgggctcccgcgacttcccggcccaaagcagcgcagcgcccgggcggcccagccccgcagcggccacagcagcatagccgggcgagcggatccagaggcccgggcttccttcctgtgcgagtcggcgcggacgactgctagtccagccgttgggcgccgcctggatctcggcgcctggcccttaaagagacccggtcgcatttcatctcagcgagaggagaaatactcgaagggagaggttcgccgctggcagccagaagccttaccactgctaggacgctggcagaacgcacccataacttggcaacactcggaggatggatggcaaataataccagcgactgaagggttaattaatgattgcagattaattgaacaccttccgtaatcagacacctggcacacactcatgatgtcacttattcctcccaacaaccctgcaaatagataactgtctctcccattctccgagcttgtcctcagagaattaggtaacttgttcaaaatggtcagaagcaacagatataactccttgctctactctttccccccttctcactactgcacttgactagtctttttaaaacataatttttttggccaggcacggtggctcacgcctgtaatcccagcactttgggaggccaaggaaggcagatcacctgaggccagaagttcgagaccagccttggccaacatggcgaaaccccatcgctactaaaaatgcaaaaattagctgggtgtggtggggggcacccgtattcccagctactcagaggctgaggcaggaaaatcgcttgaacctggaggcagagattgcagtgagccgagatcattgcattgcactccagcttgagcaacagagggacacttcgttccccccgccaaaaaaaaaattttttttttaatgatcagaagcggctgggcgcggtggctcgggcctgtaatcccagcactttcggaggccgaggaaggtagatcacttgaggtcatgagttcaagaccagcctgaccaacatggccaaaaactgtctctactaaaaatacaaaaattagccgggcgtggtagcgcacgcctgtaatcccagctactcaggaggctcaggcacgagaatcgcttgagtctgggaggcggaggttgcagtgagctgagatcgtggccactgcaatccagcctgggcgatagagtgagactacgtctcaaaaaaaaaaaaaaaaaaaaaaa

SEQ ID NO: 803 - DNA, 629 bp, Homo sapiens
  misc_feature 441, 456, 484, 499: n = A,T,C or G
gaaaagagtcaagaattttattatctgatgtgcttaattgtcatgctaagaacttaaaaaacaactcaaaaagagctaatagctaatctcctaaatctaaaaagggaattctttgaaattattttgctttcataatcaaatatattacttatgaagaataaaaataattcaaaccactacaataagtaaaatgggtatccatcacatactgtcatagagactaactgaagtagatcacttatgaatttccccattcaagtgctttcataaattcctcctcagtgaaagatagcatcttggcagcttcaatatgcatcttttgcctttttaaaacatcaattaattttaactgtttcttgaaccctatcattaattctcctttttgtttttcctagcttcttggttttccggattttaacacttccaatttttttggggtcntccatttggccatgnccctgggttattttgcccctaaattacnttaactcccaggttnaacctttccggcttcctctagagctctattccagcggaccccctgtgggcaccttggactacttgcagcccgggttttggcaggcctccctttaatttcccaatcccccttctactggaagacactggtg

SEQ ID NO: 804 - DNA, 771 bp, Homo sapiens
  misc_feature 183, 511, 582: n = A,T,C or G
cctaattgctaatgctgcagtcaaagctgctaatatcttttgcttaaagcactaatgacctatcataagaaagagttgcaccccagtaccctggtatttttcactgggttctaaagagcaaagaaaaaataaaaaagagaggggtaaaaaaaagggaggagggcagggtaggagagagcccantaggtggtttttgtcctgtggttcggattcttgagggagtgagggattcagggcatgtaccaaaagcaagagctccacccactcgaaattacagatgggtttgattttacattgagttctccagcttccttatgaacaagactttcctagccctcatcctcattactgagtatagataaacaggaaagcatggtctgaagctgccccttgacaaaaaagctgttctttccttcctctcccattccaataactgggagcggggagactctccattctgagggctcaatgcagtattaaaaacattcccctctggcaagaaataaccagntaaatgcagcactagtagttagtatataggggggttttcaccccccacccaccccctcagcatttcatctnctgcccccagatccattcaggtaatgtctctaggtctagtggtcccgaggttggagccctggggttgctgatggattctgcaaattgctgatgttgaattctgcagggagcagttccacaagttggaactgccaaattggtgtgtgctggggcacccgtccactccattgtcgcaaaatgggaactgaa

SEQ ID NO: 805 - DNA, 370 bp, Homo sapiens
cagctgcaggtgcaggagtccggctcaggactggtgaagccttcacagacccggtccctcacctgcgatgtctctggtggccccatcagcagtggtggttactcctggagctcgatccggcagccaccagggaagggcctggagtggattggggacataaattatagtgggagcacctactacaacccgtccctcaagagtcgagtcaccatatcagtagacaggtccaagaaccacttctccctgaaggtgaggtctgtgaccgccgcgggcacggccgtgttttgttgtgacagacccccaatataacagtggctggtacgactactttgactaatggggccgggggaccctggtcaccgtctcctca

SEQ ID NO: 806 - DNA, 577 bp, Homo sapiens
  misc_feature 471, 482, 496, 502, 519: n = A,T,C or G
tgcaagtacaagggtaactttattgacccccagctgggcactgcttggcccctacatcattacccccctattttggctgttgcccccatggcactgcctgtcaacttctacaacctggtgatgtctggcatcaacccctcccaaagatggaggggattctcttgcgagtgatggtggcagctgtttcagggggcacagggctaaggctgagacgtgtcacctcaactgaagcagaagaggtggattatggcattggccacgaagaaaaggaaaatgcctccgctcatgctgctggatgctgaggggctgctggtttggctggtgtcgttttgtcctgagagtccagtttgtatctgtaccataaccaggaggctgatggtgagtaggaggaagaggaacgcttcattttggtaggacttcgtggctgtcttggtagcactttttaggtgatcccagggctgtctggagctnttttggtttantgcttttgaacagnctcgtncgaatcttggcctcgangcaaattcctatagtgagccgattaaatcgtaacatgcatactgtcccgtggaagtgg

SEQ ID NO: 807 - DNA, 3542 bp, Homo sapiens
ccgaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggatgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactgtggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatactaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaa

SEQ ID NO: 808 - DNA, 6455 bp, Homo sapiens
gaggaagcgattctggggtttctgtgttgaacggttcttgtccgcgaagatgcgcttcggcctctgtcaggggacttgaacgggcttagtgggcttcagccagcttttctccaccggttccccacggggaccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggactggcagcctccatttgcctgtgaagtaaaaagctttcgtttcactccaagagtccagcgcctgaatgaacttgaggcaatgaccagagtgagattggatttcttggatcaactagcaaaattttgggaacttcaaggatctactctgaagatccctgtggtagagagaaaaatcctggatctgtatgctttgagcaagattgttgccagcaaaggaggttttgaaatggtcaccaaagagaagaaatggtctaaagtgggtagtcgcttgggatatctgccaggaaaaggaactgggtctcttttgaagtcacattatgaaagaattctctacccatatgagcttttccagtctggtgtgagccttatgggtgtgcagatgcctaatttagatcttaaagaaaaagtggagcctgaggttctcagcactgatacccaaacttccccagagccaggcacaaggatgaacattctgccgaagagaacaagacgtgtgaagactcagtcagaatctggagatgtgagtagaaacacggaactgaagaaacttcagatttttggggctgggcccaaggttgtgggcttggcaatgggaacaaaagataaagaagatgaggtcacccgaagacgaaaagttaccaacaggtcagacgcatttaacatgcaaatgagacaacggaaaggcactctctctgttaactttgttgatctctatgtttgtatgttttgtggtcggggaaacaatgaagataaattgcttttgtgtgatggatgtgatgacagctatcatacattttgtctaattcctccactacctgatgtgcccaaaggagactggaggtgtcctaaatgtgtcgccgaggaatgtagcaaacctcgagaagcctttggatttgaacaagctgtacgagagtatacacttcagagctttggagagatggcagataattttaagtctgattattttaatatgccagtccatatggttcccacagaactagtagaaaaggaattttggcggctggtaagcagcattgaagaagatgttattgtggaatatggagcagatatctcctcaaaagactttggaagtggatttccggtgaaggatgggcggagaaagattctgccagaagaagaggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggggggagccaaagacatggtatggtgtgccatctcatgctgcagagcaactggaggaggtgatgagagagctggcccccgagttatttgaatcccagcctgatcttctgcatcagttagttaccatcatgaaccccaacgtgctaatggagcatggtgtgcctgtgtacaggaccaatcagtgtgctggcgagtttgttgtgacatttcctcgtgcctatcactctggatttaaccagggctacaactttgctgaagctgtgaacttctgtactgctgactggttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatgggtgtcctgatgtcagaagaagaagtgtttgaacttgttcctgatgatgagcggcagtgttcagcatgcagaaccacatgttttctctctgctctcacatgttcctgtaatcctgagcggcttgtatgtctctaccatccaactgatctgtgcccctgccccatgcagaagaaatgtcttagatatcgctacccattagaagacctcccttctctgctatatggtgtaaaagtcagggcacagtcctatgacacttgggtcagtcgtgttacagaagcattgtctgctaacttcaaccacaaaaaagatttgattgaattgcgagtaatgctggaagatgctgaggataggaaatacccagagaatgatctctttcgaaaactcagggatgctgtaaaagaagctgagacctgtgcttctgtggctcagctgcttctgagcaaaaagcagaaacacagacagagcccagatagtgggaggactcggaccaaactgacagtggaagaattgaaggcctttgtccaacaactttttagtcttccgtgtgtcatcagccaagctcggcaagtaaagaatctgctagatgatgtggaagagtttcatgaacgtgctcaggaggccatgatggatgaaaccccagattcttccaaactccagatgttgatagatatgggctctagtctctatgtggaactccctgaattaccacgactgaagcaagagctacaacaggctcggtggttggacgaagtaagactgaccttatcagatccgcaacaagtcactttggatgtcatgaagaagctgatagactctggggtagggttggcaccccaccatgctgtggagaaagcaatggctgaactacaggagctccttacagtctctgaacgatgggaagaaaaggctaaggtctgcctacaggcaagaccgaggcacagtgtggcaagtttagaaagcattgtgaatgaagccaagaacattccagcctttctacccaatgtgttgtccttgaaagaagccttacaaaaggctcgagaatggaccgctaaagtggaagctattcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtgctgagcccccggaccgacattggtgtatatgggagtggcaaaaataggaggaaaaaagtaaaagaactaatagaaaaagaaaaagaaaaggatctggacctggagcctctgagtgatctggaggaaggattggaggaaaccagagatacagccatggtggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacagggacacttacctagtttccagcagtctgcttttaaccgggtggtgagcagtgtgtcatcttctcctcgacaaacaatggactatgatgatgaagaaacagactctgatgaagacattcgagagacatatggctacgacatgaaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaagtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaagaagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagaaccagactgccaaaggccctgcaaggacaagggagttgtatttgtaacgaagaagagagagataaaaaatattagttttaaaagtgtcctatgtgactgcttttctaaaaaggtagactgggtacaatgtgatggtggctgtgatgagtggtttcatcgggtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatcacttggaatgttgcttctaaagatgaatggccttcagagaaagtccccttagtgctggcttcctctttgcatggactctgtgggttacattgctctatcaacatatctatgcagagggtgtcttctttggtacaacagccaatatctcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattaggatagttggagagggattggagtaccactttcttccactgttaccaggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgagtatgaccagtcgtactatcttactgagccacagtgatgcatgcttttcggggaaaacttcattcacaagtattccagacaccaggcttcaggcatggccatgagcaagaccagcaaataacagctttttcccttgcagccctgaccccaatgtctgctgtttccaacactggtgatttctaactacggcccacagcagatgctgttgaataacaccatggcttcatcagaggatgtggggttgtagtacctctgggtgatgaagttgttttagcaaatccatttttaaaaaaaaaaaaaaa

SEQ ID NO: 809 - DNA, 572 bp, Homo sapiens
tgaatttaggtgacactatagaagagctatgacgtcgcatgcacgcgtacgtaagcttggatcctctagagcggccgcctactactactaaattcgcggccgcgtcgactttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggaggtcgacgcggccgcgaatttagtagtagtagtcgacccgggaattccggaccggtacctgcaggcgtaccagctttccctatagtgagtcgtattagagcttggcgtaatcatgg

SEQ ID NO: 810 - DNA, 390 bp, Homo sapiens
tttttttttattcgggaaagagacattagagttcaactactctaattcccttcatttaataaatgggaaaacttcatagacaacacagtttgatggaaaaagtaaaaataaaaataaatgagaactaaactaacccagaaaaattatagggtctcacagagagtaagtgataaaaccagagccaagtctatcagcctttttcactctgtggctcctttcactttctttagtcaccagtcctggtgtttagtctcaacctcattcctcttgttgcaatacaatcccatttctaccttgctgcgtctctaaacagataagaattgggtatacttgttccactctgaggctcaaaagacaactattctctccctgtcttttcctcttgtcctc

SEQ ID NO: 811 - DNA, 548 bp, Homo sapiens
attttttttttttttttttctagagaaaactttattgagggttgaaaacaaaataaaatacacataaggttcccttcccatctctaatatggaaaataaaacacttaatatgaatactcagttttaaactttgctctaagttttattttattttattttgagatggagtcttgctattgcccaagctggagtgcagtggcgagatcttggctcactgcaacctccgcctcccaggttcaagcgattctcctgtctcagccttccgaatacctgggactacaggcacctgccaccatgcagggctaatttttgtatttttagtagagatggggcttcaccatattggtaaggctggtctcgaacttctgacctcaggtgatctacctccctcagcctcccaaagtgctgggattacaggcatgagccaccacccccggcaacttttttaatttatattttattttttattgaaataggtggcccaaaacttgtgaaacagaactcatgctgaaggacgacattaatcataataattaaagagacagata

SEQ ID NO: 812 - DNA, 505 bp, Homo sapiens
  misc_feature 349, 350: n = A,T,C or G
ttctttttgctcggctcaaagtctgcagaaggcacgctggcggcctcaagcggggctgcatcctgcttccttctcttgctgggtatggcattagcagcttcccattcatcggatatgaggtctacagcagcatctaccaaaacctctgatgtagctccttcttggacggtccaggaggctttggaacagggctcctcggggttttcttgccaactgtctgagcccgggaacaagcacgggcccccttcctccttcagctcctgcccacactccatttcaccctccgaggccgacgccattgtggagttattgttctcagaatctgctatgggggctgcaggaggcactnnctctccgcactggctgcagaacttgggggtttctccttggagacatgctggcacgaaggacactccatgggtcctgctgggactgccctgcagatccagaagcaagagcaggagtcgctggcagcctgctatatactacatgtcctgtcacgtga

SEQ ID NO: 813 - DNA, 3765 bp, Homo sapiens
agcggagcggcgacggcgtcggcggcggcggcggcagcggctccggccgaggtgcgcgctgggggggagggggggccggagaggagcatgaatggagcaaaatggcggatcatgtgcagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggatagtgttgaatactgcatcattggtgtcacaattttatctcagctaaccaatgaaattaatcaagcagacaccacccatcctttaaccaagcacagaaaaatagcctcttcttttcgcgattcatcattatttgatatcttcacactttcctgcaatttactaaaacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcagccttcttagattcttcaaccttgcagctgttttttgacctgtatcattccatccctccttcattttcacctctggtattatcctgcttggtacagatcgcttcagtcagaagatccctgtttaacaatgcagagagggccaagtttctctctcatcttgttgatggtgttaaacgaatactggaaaacccacagagtttatcagacccaaacaattaccatgagttttgcagactactggcccgattgaagagtaactatcaactgggagaattggtaaaggtggaaaactaccctgaggtcatccgattgatagccaacttcacagtgaccagcctacagcactgggaatttgctccaaatagtgtgcactatcttctgagcctgtggcagcggctggcagcctctgtgccgtatgtcaaagccacagacccccacatgctggaaacttacactcctgaggtcaccaaagcctacatcacatcccggttggaatctgtgcacatcatactgagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggaaggctgacatggctggtttacattattggagcagtgatcggtggccgggtttcttttgccagcactgatgagcaagacgccatggatggtgagcttgtctgtcgggtgctccagctgatgaacctaacagattctcgtttggcccaggcgggtaatgagaagctagagttggccatgctgagcttttttgaacagtttcgtaagatctacattggggaccaagtgcagaaatcctctaagctgtaccgccgactctcagaagttctgggcttgaatgatgagaccatggtcctaagcgtcttcataggaaaaatcatcaccaacttgaagtactggggccgttgtgaaccaatcacctccaagacactacagcttctcaatgacctgtccattgggtacagtagcgtaaggaagctagtgaagcttagtgcggtacagttcatgctgaacaatcacacgagcgagcacttttcatttttgggtattaacaatcagtccaacctgacagacatgcggtgtcggactaccttctacacagcacttgggcgtctcctcatggtggatttaggagaggatgaagatcagtatgagcagttcatgctgccactcacagcagcatttgaggctgtggcccagatgtttagcaccaatagtttcaacgagcaggaggcaaagcgaactctagttggcctagtaagagacctgagagggatcgctttcgctttcaatgccaagaccagcttcatgatgctctttgaatggatatatccatcctatatgccaattctccaacgggcaattgagctctggtaccatgatccagcctgtactacacctgtactcaagttgatggctgaattggttcataataggtcccagcgactccagtttgatgtctcttcccccaatggcatcttactcttccgagaaaccagcaagatgataacaatgtatggcaatcgcatcctgacactaggagaggtcccaaaggatcaggtctatgctctgaagctcaagggcatctccatctacttctccatgctgaaggctgctctcagtgggagttacgtcaatttcggagtctttcgtctctatggagacgatgccctggacaatgctctgcagaccttcatcaagctgctcctctctattcctcacagtgatctcttggattaccccaagctcagccagtcttattattcactactggaagtcctgacccaggaccatatgaactttattgcaagcctggaacctcacgtcatcatgtatattctctcttccatttctgaaggacttactgcacttgacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcagatgctgtccacggtgctgaacatcatcatctttgaagactgtaggaaccagtggtctatgtcccgaccactacttggcttgatattgcttaatgaaaagtatttttctgacctaagaaacagtattgtgaacagccagccaccggagaagcagcaggccatgcacctgtgttttgagaacctgatggaaggcatcgagcgaaatcttcttacgaaaaacagagacaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccataacctgccttgtataaacatgtacattttttcataacattttgaacaaggtttatattgactcaagtttaaaaacgaaaaaaaaaaaaaa

SEQ ID NO: 814 - DNA, 474 bp, Homo sapiens
tgtccggaatgtggtaaatgtgatttggaaaaccaaagagacatgatggtggagaataaggagagttgtcagaaaggtttccctgcagataaacttttaaagatctcaacctgtggacgggaaatgtggggttggagcccccacacagagtccccactggcacagtggctcatgcctgtaatcccagcacttctagaggctgaggcgggtgtattgcttgagcccagaagtttgagagcagcctgggcaacgtggtgaaaccctgtctctacaaaaaatttaaaaaattagccaggcatgagggtacacacctgtagtcccagctactcagggggctgaggcgggaggattgcttgagcctgggaagtggaggctgcagtgagcctaggtggtgccactgcactccaacctgggggacagaggaggccctgtcccgagtgcggcaaaaaaaaaaaaaaaaaaaaaaaaaaaaaa

SEQ ID NO: 815 - DNA, 523 bp, Homo sapiens
ctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaaaaa

SEQ ID NO: 816 - DNA, 1702 bp, Homo sapiens
aaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacat

SEQ ID NO: 817 - DNA, 863 bp, Homo sapiens
ggcgcgtgagcagctgcagcggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggcgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgccaaaaaaaaaaaaaaaaaaaaaaaaaa

SEQ ID NO: 818 - DNA, 557 bp, Homo sapiens
  misc_feature 425, 451, 470, 494: n = A,T,C or G
aagagacagcctagctctgtcacccaggccgagtgcagtgttgtgatcacagcgcactacaacctcaaaatccgggacttaagtgatcctcctgcctcagcttgccaaactgctaggattattgaggtgatcggctgcactcaactccatttttttcatcagcctttttgtcaaggactgatgagccctgccttctggaaacattcttgataatcatgacattaattttctgattcccctctaacctctgaactcccctctcacttttctaaagcgctttcttttcctgctaatctgtcagggcccagaaacaaatcaacaggagttcccattggagtggtatgaaaagagagatgcatttcagggaagggtttagatacgtgaggtccatagtggctttactaagcattaatgggtggtgaaanggagaaagcaaagtcacaatccgatncaaatctagaagaaaatcntagttggtggattaacaagttgtnggcccttgcaatgtacccggaaaataatgccttacttccaaagcatggctttcaaacctactt

SEQ ID NO: 819 - DNA, 2970 bp, Homo sapiens
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaa

SEQ ID NO: 820 - DNA, 318 bp, Homo sapiens
  misc_feature 255: n = A,T,C or G
tataaagaagatcatgtccatgttaacattattataaccctacattttgtgcataaagtgtaagtgtataagcatatcaatattaaaaagcaagcaagcagaatttggaattcatccaatccaaatgcggcatcttcaaacctccatgatgctgcttacatgtctcgatcccacttaactatcttgggctgtgacaaagtcacatggttcacacggcaggcatactcatctttttcagtgggggtgaattcagtngtagtacaagagatagaaagaccagtccttgctgaaagacaagtctgaatgctccactttttt

SEQ ID NO: 821 - DNA, 502 bp, Homo sapiens
ttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtat

SEQ ID NO: 822 - DNA, 538 bp, Homo sapiens
ttttttatttggaagcaaaatttttattttttaagaacagagctatttcataaagccagctacaacatctgtggtacaaactcatcccagctctctcgccatattccctctctgtagacccagagaccatatccataacccaaagggacacagggagggcagacagaccttctttaggagagaagtttagaaactgatccacttcatgaggctccagcttaattttaggaataatggtctggcacgaggaatcaaccccagtgttcatttccagaggaggttcctccttttccaacggggtggagatggctgtgatggtcagagtgacagacggaacgagtcctgggggtggttcgtctgtaactggctctgtcttgatggatgttgaagggaagtctgtagacaggtaccatttctcactttccacctcatcgtcattgaagctgtcactggtggtaatgtgggtgaagggcgactgggcccgaggctcctcgcacagggagtagctgtgctcagcctggatgagaggcgccgggga

SEQ ID NO: 823 - DNA, 579 bp, Homo sapiens
  misc_feature 568: n = A,T,C or G
gatttttttctttttttcgacccacggatttattcttattgcccaggcttgagtgcaatggcgtgttctcagcttactcaacctccgcctcttgggtttgggtaattgttgtgcctcggcctccctctgcctcttgggcttgggcgattgttccacctcatccgccctccgcctcttgggtttcggtgattgttccacctcatccaccctccacctcttgggtttgggtggtttttccgcctcggcctcctgagtagctaagggaggagtcttgagattatcatccactgagggtggaagaggagagggtggaagagggacaaagagacagtccttcagattatcatccactgagggtggaagaggagagggtggaagagggaccaggagacactccttcagattatcatccactgagggtggaagaggagcaagaggacactccttgatattatcatccactgagggtggaaggggatgaaggagacattcgggaggtgtcttgaggctcagggagttatcagttatagaatgttgttgagttggaggaggtggctggcggcccatnctgttttttaa

SEQ ID NO: 824 - DNA, 1073 bp, Homo sapiens
tcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgagggccctcctggacccgggagcggaccctggtggcggtgaagcccgatggcgtgcaaggcggctcgttggggacgtgatcmagcgctttgagaggcggggcttcacgctggtggggatgaagawgctgcaggcaccaraaagcgtccttgccgagcactaccaggacctgcggaggaagcccttctaccctgccctcatccgctacatgagcwctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcaactccgtggagggggcccagcgggagaaccagcwgtggttccagagcagtaagctggtgagctgggcagacgggggccagcacagcagcatccacccagcctgaggctcaagctgcccttaccaccccatcccccacgcaggaccaactacctccgtyagcaagaacccaagcccacatccaaacctgcctgtbccaaaccacttacttccctgttcacctctgccccaccccagcccagaggagtttgagccaccaacttcagtgcctttctgtaccccaagccagcacaagawtggaccaatcctttttgcacaaagtgccggacaacctttgtggtgggggggggtcttcacattatcataacctctcctctaaaggggaggcattaaaattcactgttcccasmmawggggtggwamttaatwatgamttccccagccctgagggagaaatracgcyttttgcaagtggtaggrgtkgamagtaaaaggagttttg

SEQ ID NO: 825 - DNA, 2104 bp, Homo sapiens
gctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaattacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagatttttatatttgccactgttagatagttggaaaggggaaattctgtttaagcgaaagtggtatcatcctaggtaagcttatttcagaacaagtctaatatatcagattctttcttttcgactttatactctgagttattacttactgtaagtggtgtatatgaaacctccatgcattttccagtatggatctgctaatatgcacagtaaatccatgtctttgtttgtttttctattaagaagcaatcaagaaagataatgtgaaaaagaaaggaatttagaggtagggaaaagatgaatgtcagacatgtgaagaactatagtaaaaatgataaaccacctaaatatccttgaacctaccttaaaatgccaatgaggtaggcctgatctttgaatagtggctaggatacaatgcatttcctcagtgatcactgattagaatgagttggtgggatccttgggaagccaaacggagcggggttctggatcatgtcccatccagtccagtgaatccccgacccgcagacctgccccccccgcaacagcttataccatggaatgaggacaaggtgatactctgagctgtggactgaactggcagacacaacctgtacagattgaaatttcaccttgtaaggaggaagtgaatgaaataaaggatccccctaagg

SEQ ID NO: 826 - DNA, 558 bp, Homo sapiens
  misc_feature 16, 18, 242, 247, 287, 402, 421, 447, 449, 450, 456, 475,480, 484, 509, 528, 535, 537, 541, 544, 551, 554, 555: n = A,T,C or G
tttttttttttttttngnggattcaaaattttaataataaattgtgccagtagaagcttttcaaaggtaatgatatatcaataaataatagttaaactgagttcctgagaaagaacctaccacatgaaagtatgtcagagcgctgtgagtaacaacatggcacgactataaaatagcgagaatactgacagtcacgacgacaggcacagcagacttgagtatgccactcacacaaatgtaanccagnacacaggaatctttatttttttagtttaaacactgataancttctaagtgttgttgcctagatatatactaagtaatggatacattatgctaagaacttcaaggaaaaatatgtggaataatataatgaaaattatgaagcatcagattttttanaaagcaaaaaagattgganctttttactcaaatattaatcacttnanntaggantcatactaattggaaatanggatntggngttactctggggggtgggggggggngttttcacgccatcatctntcttctngnaatncgnttggttnctnnccc

SEQ ID NO: 827 - DNA, 1466 bp, Homo sapiens
gccctctagggtagaatcgccaagctttgagagaaggctgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgttctcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggaggacagggagatgctcgagttccaaaagagaaggtttcttccagagtcatctacctgagtcctgaagctccctgtcctgaaagccacagacaatatggtcccaaataaccgactgcacctgctgtcttcagctcttcttgacatcaaggctcttccgttccacatccacacagccaatccaattaatcaaaccactgttattaacagataatagcaacttgggaaatgcttatgttacaggttaccgttgagaacaatcatctaaatctatatgatttcagaaatgttaaaatagactaacctctaccagcacattaaaagtgattgtttctgggtgatttattgatgatttttattttctttatttttctataaagatcatatattactttt

SEQ ID NO: 828 - DNA, 7931 bp, Homo sapiens
gggagagggagacgcaggcggcgaaacggcagaggagccgagccccctccgcccaaggcgccctccctccgtccgcgcacaggcgccgtcgcttggaggagcaaggtgcctcccagcccgcaggggcgccgcgcgcaagcccgcgggctcttcggtggctctgccccgggactgcacctggaggcggccccggacggggatggtcagcggctgctgccgtctggctcgcgagcgggacgctgtgagggcaccatggcgctgactcccgggtgggggtcctcggcggggccggtccggccggagctctggctgctgctgtgggcagccgcgtggcgcctgggtgcctcggcgtgccccgccctctgcacctgcaccggaaccacggtggactgccacggcacggggctgcaggccattcccaagaatatacctcggaacaccgagcgcctggaactcaatggcaacaacatcactcggatccataagaatgactttgcggggctcaagcagctgcgggtgctgcagctgatggagaaccagattggagtagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcccagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaagtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 829 - DNA, 1661 bp, Homo sapiens
ccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtcaaaaaaaaaaaaaaaaaa

SEQ ID NO: 830 - DNA, 3384 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctactggcccacgcccccacctgccctgcgagaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacataaagcaaaagggagatgtggtgctgcagagtgaccacgtgattgagacgctgaccaagacagccctcagtgccaaccgcgtgaacagcatcaacatcaaccagggcagcataacgtttgcagggggccccggcagggatggcaccattgacttcacacccggctcggagctgctcatcaccaaggccaagaacgggcacctggctgtggtcgccccacggctgaattatcggtgataaaggcgcccactggaccatcccaacgcccaaagctttgcttttctcctcctccccttcccagttaccaaagagtcgaatttccagacagggacccagggacaccccgaagcccacctgcaatttcccacctcctgcccatccctttcttgagggagcagcaggggccaggagctaccccaggagtgggccaggccgggccacagcaataggaaagccagggccagagcga

SEQ ID NO: 831 - DNA, 457 bp, Homo sapiens
  misc_feature 1, 139, 272, 274, 389, 397: n = A,T,C or G
ncagcatttttcggcctctttatttagaacccggcggacgaggggccggggcagtggtacagacggctcaggaaccattttaacagacttgtcttcaagtttcagataaacacagtcataataagagagacagcgaaanccgaagagactgcaagctagatgggcatgtatggcagctacagcttgtgagtgacccccttccccagagtccgcgatgaaaataaagttacacttgtcaataaccagatgtgggagatggagagtgcctttgnantaaccaataaccgagctagtgcgtggcagagcggtccacgccttggacataaatagaaaatataagttagtataactttaaaaactttttgtacaaatatacatggtttttttantttttccntttttttttcctttttcctttttttgcactgagtttcagcagagattaaacattttatat

SEQ ID NO: 832 - DNA, 2320 bp, Homo sapiens
tacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaagctcgcggctcacggcgctcctggggcagccccggcccggccctgcccggcggccctatgccgggggtgccgctcagctggctctggacaagtcagattcccacccctctgacgctctgaccaggaaaaaaccggccaaggcggaatctaagtcctttgctgtgggaatgttcaaaggccagctcaccacagatcaggtgttcccatacccgtccgtgctcaacgaagagcagacacagtttcttaaagagctggtggagcctgtgtcccgtttcttcgaggaagtgaacgatcccgccaagaatgacgctctggagatggtggaggagaccacttggcagggcctcaaggagctgggggcctttggtctgcaagtgcccagtgagctgggtggtgtgggcctttgcaacacccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggggagactgtggccgctttctgtctaaccgagccctcaagcgggtcagatgcagcctccatccgaacctctgctgtgcccagcccctgtggaaaatactataccctcaatggaagcaagctttggatcagtaatgggggcctagcagacatcttcacggtctttgccaagacaccagttacagatccagccacaggagccgtgaaggagaagatcacagcttttgtggtggagaggggcttcgggggcattacccatgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtagatcatgccactaatcgtacccagtttggggagaaaattcacaactttgggctgatccaggagaagctggcacggatggttatgctgcagtatgtaactgagtccatggcttacatggtgagtgctaacatggaccagggagccacggacttccagatagaggccgccatcagcaaaatctttggctcggaggcagcctggaaggtgacagatgaatgcatccaaatcatggggggtatgggcttcatgaaggaacctggagtagagcgtgtgctccgagatcttcgcatcttccggatctttgaggggacaaatgacattcttcggctgtttgtggctctgcagggctgtatggacaaaggaaaggagctctctgggcttggcagtgctctaaagaatccctttgggaatgctggcctcctgctaggagaggcaggcaaacagctgaggcggcgggcagggctgggcagcggcctgagtctcagcggacttgtccacccggagttgagtcggagtggcgagctggcagtacgggctctggagcagtttgccactgtggtggaggccaagctgataaaacacaagaaggggattgtcaatgaacagtttctgctgcagcggctggcagacggggccatcgacctctatgccatggtggtggttctctcgagggcctcaagatccctgagtgagggccaccccacggcccagcatgagaaaatgctctgtgacacctggtgtatcgaggctgcagctcggatccgagagggcatggccgccctgcagtctgacccctggcagcaagagctctaccgcaacttcaaaagcatctccaaggccttggtggagcggggtggtgtggtcaccagcaacccacttggcttctgaatactcccggccagggcctgtcccagttatgtgccttccctcaagccaaagccgaagcccctttccttaaggccctggtttgtcccgaaggggcctagtgttcccagcactgtgcctgctctcaagagcacttactgcctcgcaaataataaaaatttctagccagtcaaaaaaaaaaaaaaaaaaaaaaaaaaaaaaaaa

SEQ ID NO: 833 - DNA, 2021 bp, Homo sapiens
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcctcctcctggccgctctgggtgtgacagctggtgcccatcgcttgtggagccacaggtcctaccgggccaagctgcctctgaggatatttctggctgtcgccaactccatggctttccagaatgacatcttcgagcggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgagtggcatcaagggcatatattgaaagtcacccttcccggattacacattttagctttgttacatactcattgtaaccactccgaaaagtgctgcttgatgctgcgtgctctttctgtgtccctggaggtattctgaaggtcagaagagagatatacaacagcgaggcttggtgataacgtatagaataacagacggggactccacacccaggccttttttaacggtgtgaagcatagacagagctgcagtctgtgctaacattaggttatttattgattcaatcagttgacacaaggaggcagctacggggaggtaaaatatggtcctaaaatcaaaaagatttcagttttgtcattctgtctctgagattctatttccacatctagagcagggtaataatgatacctaccttacaaaattattgggagaatacattagttaatatatgtgaaagtatggaggagatgtgcaataaatatttgtgttattaactacacatacagcactctataggagatattccatttataaaaactttaggttctaaaaacctgtacacgttgattatttttgtaagtcaaaagtgattaagaggagtttaagctatcatttccagatgtatttctataaataaaaacataagtatattcagttgatttggggtggagagttccatagatgtctgttaggtccgcttggtccagagctgagttcaagtcctgaatatccttgttaattttctgtcttgttgatctgtctaatattgacagtggggtattaaagtctcccactattattatatgggagtctaagtctccttgtaggtctctaagaacttgctttatgaatctgggtgctcctgtattaggtgcatacatatttaggatagttagctcttcttgctgcattgatcccattaccattatataatgcccttctttgtcttttttgatctttgttggtttaaagtctgttttattagagactaggattgcaacccctgctatttttttttttttttttgcttgataaatattcctgtatccctttattttgagcctatatgtgtctttgcacgtgaggtgggtctcctgaatacagcacaccgatgggttttgactctaaaaaaaaaaaaaaaaaaaaaaaaaaa

SEQ ID NO: 834 - DNA, 990 bp, Homo sapiens
tgtkattcatacatttgsgttgatttatatacattacgtacaatttctacattgggttagaagaatgacacagggggcagcaacactctcgcagcccagcctccattccctgacactggaggcagggcctatggctggcagagggacggtgttccatgagtgccactcagaagcctcccccggcattctgggcccctggctcttccagagtccacattcaaggcaacctgagcacaggcttgagggagagtggagaaaggccaggaaagggtgcccacactcttgcctgccaggcccaggaccagctctctcctacactggacccaatttccttctgatcacagagctggtctggatcaagacaatgtggagatctggtgtggaggctgtggccaggtgaggcagccgggctccctgttagacccccaggctctcttgagcaccagatgggcactttaccaacaggtttgggtaaaaatgtctacagagagctatgcacacctgggtccccttctggctcctacagtcaaggggcaagtgttctctcgaacattgttcccaaggccagtgtccgagtcagctgcatgtgattgtcggggctgggattggggcaggcaggcgagctgtaccttcgtccacagggcatgcacatccagctctcagaaattcttcctgtcagccaggtggaagcccgggacaagtggactcttggtggctggactggaaggggaccggcggggaccagcctggaccagctgaccagagggctgcacatctctgctctgcagccgggcaagcagaggacatgcagccatagtcctcactccctttctttggttgtttttcaaaccttcaagatagttactttctgaggttgactgaccaatcgcaaggtgccagaattgtgaaatgtccagtagcacagggcatgaacacagctgccctccagacacagatggcacctttttactccycctgagscgtacttgc

SEQ ID NO: 835 - DNA, 3565 bp, Homo sapiens
tttttttgaatctgcggaggcggcggcggtggcagcggcggcgcggcgactgaagcgcgcgaaaagctgaggcggcaacgtcggggacggctgcgcgggacggctctgtaggaaggaacttggttccccctccctcagcttccgccccaaaagattcagaatggacagtttagaagaacctcagaaaaaagtctttaaggctcgaaaaacgatgagagtgagtgatcgtcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctattgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagatgaaatcattcctattttggaaaagcttgcaccttctgaggatgaacttacttgcttttctaaaacatctctccttccaatcgatgagacaaatccagatttggaagagaaaatggaaagttcttttggttcaccatctaaacaagaaagtagtgagagtttgccaaaagaagcctttctggtcctctctgatgaagaggatatttcgggtgaaaaagatgagtctgaagttatatcgcaaaatgaaacgtgctctccagcagaagtagaaagtaatgaaaaggacagcaaacctgaggaagaagagcaagtaatacatgaagatgatgaaagaccttctgagaaaaatgaattttctagacgaaaacgttctaaatcagaagacatggacaatgtacagtctaaacgtcgtcgatatatggaagaagaatatgaggcagaatttcaagtaaagattacagccaaaggagacattaaccagaaacttcaaaaggttatacagtggttgctggaagaaaaattgtgtgcgctgcagtgtgctgtatttgataagactttggcagaattgaaaacacgagtggaaaagattgaatgtaacaagaggcataaaacagttctcactgaactacaggccaagatagccaggttaaccaaacgctttgaagcagccaaagaagatcttaagaaaagacatgaacatccacccaacccaccagtatcaccaggaaaaactgtaaatgatgtcaacagcaataataacatgtcttacagaaatgcaggcacagtgagacagatgctggagtccaagagaaatgtaagcgagagtgcaccaccatcctttcaaactcctgtgaatacagtatcttcaaccaatcttgtcactcctccagcagttgtcagtagtcaacctaaattgcagactccagtgacttcgggttccctcacagcaacgtcagttcttcctgcacccaatacagctactgtagttgctactactcaggtgcctagtggaaatccccagcctacaatctctttacagcctttgccagtgattttgcatgtacctgttgcagtatcctcccagcctcagcttctacagagccatccagggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaaggtacttcaatagtaattgtactaagcaacgttttgataccattttttttgtcttaatacggtacagtattctacaaagacagatgtttatggcattatgcttggtttatttgtgttctttttggaatggaagttttttagattagaattttaaaatttggccaggtgcagtgtctcacacctgtaatcccagtgctttgggaggccaaggcaggaggatcgaggcaagaggtcaggagtttgagaccagcccgggcaatgcggtgaaaccccgtctctataaaaaatttaaaaattagctgggtgtgatggcatgtgtctgtggtcccagctgcatgggaggctgaggcaggaggatagcttgagcctgggaggttgaggctgccgtgagctgtgtttatgccactgcattccatcctgggtgacagaatgaggccctgtctcaaaaaaaaaaaaaaaaaaaaa

SEQ ID NO: 836 - DNA, 568 bp, Homo sapiens
  misc_feature 111, 208, 383, 402, 526, 545, 555: n = A,T,C or G
aaccaataccccatctcttaaaaaaaaaaaaaaaagagatggggtattgctatgttgcctaggctcgactcaaattcctgggcctaagcagtcttctgcctcactctccanagtaggtggaactacaggcatgagacacagcatctacaggcatgagacacagcatcttcctgtctttttggctcctttagtcccatctttgtccctntgccccacccctacaggtttttttgttgttgttgtttttgggatggagtctcacactggcgcccaggctggagtgcagtggtgtgatctcggcttactgcaacctcctcccgggttcaagggagtctcctgcctcagcctcccaagtagctgggattacaggcacctgccaccgnacccagctaatttttttgnatttttagcagaaacgcggtttcactatgttggccaggctggctcaaactcctgacctcatgatctgcccgccttgggcttccaaagtgctggggatacaggcgtgagccaccgggcttgggcnggttggttggttttttganacagggcttnttgggcacccagc

SEQ ID NO: 837 - DNA, 435 bp, Homo sapiens
tttttttttttaattaaaacagcaaccaggtaactgccccaacccatcagggaaaggacccgggatgggcagtcgttttttcaaaaaaatatattttctttttttaaaaacaacaccaaagcaaacccatagcccctgtcaagccagtcctcagggagagtgagctggaaggctccccctgcacttctctgagcagagatcttgggcccctcccactggaccccagcctgagcagagggcaaggctctgcatgctggtaccctagggggttgggggagaagcgatcagctccaaaccatgcaagaaaaacaagccaaacccataaagcaaaagaaaaaatcaacagaggataaattaaaaaaaacacgaaaggtgaatgacacttgggacaaatggctcgcacagagccaggtgggagcagccccctcggttcct

SEQ ID NO: 838 - DNA, 7350 bp, Homo sapiens
tgtgcgtcgcgctctcgccctcctcttcccgctgcagtgtctatggagcgaggctacgtttcattgccgccctggcttaacccttccggcgcctaaaaggacggccggccggccggtcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggattcggccaaggaatcttccgctcgctccggagcgaggagcctgtaaagaggctgttcccagctccagctctaacctcgcctacaccttgggcgggcccaatgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttccttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggtttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaaaatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatat

SEQ ID NO: 839 - DNA, 2365 bp, Homo sapiens
aaaaagacctactttgtgagagagtatagtgtcctccatgatgtcaacctcaatgaatcagataggtcccaagccatatctgtgggttaataatccatcatgaatcaattgccattaacttgccaagaactttttttcaatttcagtttgaagtttcactcttctgtgtgcttatttgtttgttggtttgttatgttttagccactgtaggcttctagagagaataaccattcctttcctggcccacgccctttccagtttgctttccagggtagagttactaattaaattccagacacttattaacaaacttttattactagacaggatcatgcacatggatgtaactccttttagctccatcttttcctcactccctctgattggttggtatgaccaaagggccattgtccagttccatatagggaagggatctgtggggtcttgctggctagctccctcacccttccaccttctcactctctccatgcattatgtatgcttcacatgggccttgctcatgtgaaacgaatgcccaggagttcaaggttgcagtgcaaggaggcccaagcattcttctctttgcaatctggtacttacagggttctaagtactccattaaaactgggtgtgtgggaggagaagaaacactgggcagctctcctacaaccagtatccctaggaaggaaatggaagaaaagaccctgtaatttggatgactatgtatggggacagctgaaatacataccacttaagttctccttcactgctgctgctgctgatcggcaatgtgtgaaagcagctgagccaggagagcccagcatgcacgcggctgccactgcaatggcaggtaccagggccggtactacatttgatgaattacaatgccaagaagacatggtttgtaccaggtttgaaaacaaggcctatgtgaataccaatgactttacgagacaataaggaaaaacaacgtagactgagttccccatctagtgacacccacagccctagcttcctccttaagcccctcagactgttttatctctgaactggttagtgaagacttaaaaacatagtcctgcaggttgactaagaaaaatctttaagaatggcaactggtgggtgttaccttcactcactgcaagatctgccgtatatatggtttaaaaagaattttaaaagttagttaaggtcaatcatggtggctcacacctataattttagagctttgggaggtcgagaagcacgaggattgcttgaggccaggagttcaatatcagtttgggcaatatggcgagacctcatctctacaaaattaaattagctggggtggtggcacacgtctgtagtcctagctactcaggaggctgaggcaggaggatcgcttgagcccagaagttcaagggtgcagtgagctatgattgcaccattgcacctccagcctgggcaacagagtgagactctgtcaaaaaaaaaaaaaaaaaaagttggtagggaaaagctaacaagagacttttgaaaatagaaaatagagtaaatagcattattcaagacacagaaagaaagcaggaaagcatatttgtgagaaataattattaaaggggctaggcacagtggctcacacctgtaatcccagcactttggtaggccaagatggctggatcacctgaggtcaggcgttcaataccagcctggccaacatggtgaaaccccgtctctactaaaaatacaaaaaattagccgagatggctggatcatctgaggtcaggagttcaataccagcctggccaacgtggtgaaaccccgtgtactaaaatataaaatacaaaaaattagctgggattacaggcacacaccacaatgccaggctatttttttgtattttcagtagagacagggcttttgccatgtcgcccaggctggtctcgaactcctgagctcaggcaatccactccccctttggcctcccaaagtgctgggattacaggcgccaccgcgcctggccaaaaggcatttcattctttttattttattttattattatactttaagttttagggtacatgtgcacaacgtgcaggtttgttacatacgtatacatgtgccatgttggtgtgctgcacccattaactcatcatttacattaggtgtatctcctaatgctatccttcccccccccaccctccccaccccacgacaggcccaggtgtgtgatgttccctttcctgtgtccaagtgttctcattgttcaattccgacctatgagtgagaacgaaggcatttcattcttgatgatggtggtggtgatgatgttgatgacaattatattaataaagccattgctgtgaaaaaaaaaaaaaaaaaa

SEQ ID NO: 840 - DNA, 483 bp, Homo sapiens
tttttttttttcacatttgagcagagtttattagcatttttgaattatcagagataatattagattacagtatcatatagtattagataagatgcaccgttgacacaggtacagaagtttccatatagttcaactgattttttatttattttttatttttttgagatagggtctgactctgtcacccaggctggagtgcagtggcaccatctgagctcactgcaacctccaccttgcaggctcaaacgatcctcccacctcagcctcacaagtagctgggactacaggcatctgacaccacacccagctaatttttgtatattttgcagagacaggatctcgccatgttgcccaggctggtctccgactcctgagcccaagtaatctgcccccctcggccacccaaagtggtgggattacaggcatgagccaccatgctcggcccagatcaactgaatttaggatttgatattactttgactt

SEQ ID NO: 841 - DNA, 529 bp, Homo sapiens
tattttgtaatcaactgaaagaaggcagaaggagtcgatgggcctcttaggcgagaaaccttacaagcataggaccaaggcagaaaaggtccagagggttcatggtcctccgttccacctgaatccagctagagagcgagccagggggataggtgtgcccctcgtcgcccgtgcgctgaggcactgtcacgcaaagagacattcaccttccacgtcaacgcacctttaagggcgagacggtccgccgtgcccaagaggaacgggatgacattcaactgggacttgcctcaccttggcttgggggacctcgagagcggtcccgtgggggcagtgttactcgtggtggtagaagtggagggcgtgtccgggtacttgagttcatgggcatctctcccgccgcctctcagcctatctgcaccatgtctcacacgttcagttgcagctcttaccgttttgaaggcgcacgtgggcaagaagtcctgggcagcacaagaaagtcaatcacgttgagacagagagagcaggagag

SEQ ID NO: 842 - DNA, 1995 bp, Homo sapiens
cccaaagaactttcactaaaatttatatctaagaattctcccctaaagaactttaaaaattaggctccactctgaagccagccagggtcccaccagtttccacttatagtgccacaattccagaacaaaggagaagccattctgatgagaacgactttgtttcaattttgaaaaaccacggatcaggaaatacctgaagtataatttttagaatccgagttgtcacatcaccttcaggatgttttcttattgttaatgccatgtgacaataaaagataacaatttttatataaataatatttctgttaaaattctgatctcaacttagctattgttagtttacaaatagaaaggtagatatcataaattaggtaagcaaagcatgcaaatctaaagcatctctatctgaattcctagattagcgttaaaaccaatcaccgcaacaaatacctcaacagtatgcctcgtgtgcagaaaggaagcgatactgaacattcaatgccacaactgtaaggttttcggagaagcacctgtggcagtttcagcagtttctatatggaatgctccccctttctaggattacttgaaaaaatcaagtcaattcgaattacgtagctgtaaaacattgacatgtgtagtttttacagattcagaatcttctgtgtgatttaaaacgggcaatggttcataatacaggaaacttaaataataagggatcacatatttgcaggcaacatttggattaaaaatacatagacaacataaggtgcagaagcacactgagcttaagccattgtcatgtgaccaccttgaccatgagctactgctctaaaacactgccttttaaattacctttggtaattttttagcatgaagccaatttaaatatgtcaatatttcaacataagtttaacagtatggactaaaaaccatcaactcacgattctggttactttaaaatttggtatgctgtatctcaaatacattagtaactattcctagatggaaataagcaaatacatggaatcattaaaaaaagataaaaaacattactaaattgtccatttgtaaagataaaacattagcaaacatctaagatatcttcagcaaaagaaatacatgtgtatttttaaccctttggtatccaaactcttatttaattatgaagactttcttaaatatattcttcagttaataataggaaaaaactatttttaaagagtttctacctaaataaatttggtgccaagttttcaagtttaaagttactgagaatagttttacactgcaattgaaccaaaattatgttttcaaacattaaaatgtaaaaccatcattccagtagtctgatgaaatatttagcatgctcctgctataatttagcaagggagaaagacatttggatttagcaaacactggttttatttgaaagcactacctataaaagtagtaaggaaattattaaaatctgtattttaatcaagctgctatgaaaaacaatcaaaattctgaacaatttcttaacaagtctagaatgatatcaacccacttactgtccctttctagcaggcagaacttaataactatctcaggaactgattcctccatcctgaaacaccttaacaaccggaaaatagccaagaccagacaagtctgctgtggggacaattagataaaaggaggctgcacagtggctcacacctgtaaacccagtgctctgggaggccaaggtggaaggactgcttgagcccaggagtttgagaccagcctgggtaacacagcaagaccccatctctacaaaacatttttaaaaattagttgggcatggtggtatgtgcctatagtcctggctactcaagaatctgaggcaggaggatcactggagcccaggagtttgaagttgcagtgaactataatcatgccactgtactttagcctggacgacaaagggagactctgtctctttttagaaaaaaaaaaaaaaaaaaaaaaaaa

SEQ ID NO: 843 - DNA, 1874 bp, Homo sapiens
gggtcgaggcgacgtatcgataagtttttttttttttttttttttttaagaaatagggttttgctctgtcacacagactggaatgaagtagtgcagcctcaaactgttgggctcaagtaatcccccaacctcagcgtccccagtagctgggattacaagcatgtgccactacacccaattaattttttttttttttttgagactgagtctcactgtcaccaggctggagtgcagtggcatggtcttggctcactgaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccgggcaagtctgtgcttgagagaaactccccagacgactgcctgcctgtaagagacagtgaggaaacgcaaggcaggagacacattttcttcagttttatctgcgtaagcctgaagctttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtctatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaaaaaaaaaaaaaaaa

SEQ ID NO: 844 - DNA, 5277 bp, Homo sapiens
gctgcataaagctgagagatgcctacagctgagagtgaagcaaaagtaaaaaccaaagttcgctttgaaaaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgcaaaaaaaaaa

SEQ ID NO: 845 - DNA, 550 bp, Homo sapiens
  misc_feature 35, 446, 476, 542, 549: n = A,T,C or G
tttttttttttaaaggagcaatgacatttcctagnaagttactctaagaatttccctagagggtcgggtatcatctcagccagatctttctcatccttcaaggccctgtttggtacagcttgctaggaagctgttccagactgcagcagccctctctggggtctctctaccacttcccaggcactcagaacttgtgcctcagtagactgttttgtggcactgtcccattctctgattctccatgtgagctggttttatcccatccagcatggctgtgaaatcctaaaggttcaaaccccagccactcttcacctatatttcccccaaatgggctagcacgggaaagggcccaaagtaggtgctcagtgctgatgagagagtaggaatttaaataccccgggaagcattgtgagttactacggaggccatgaaattgttgccacctncccaaggtggttaaagagtgatattagggnaattaggtaggggaagggttaatcaggaattgctttggttcaggaggtgttgagttttaaagtccngagggcna

SEQ ID NO: 846 - DNA, 3076 bp, Homo sapiens
gaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcaaagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaatacctggttttttttttgttttgtttttttgtacagacagggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattc

SEQ ID NO: 847 - DNA, 2504 bp, Homo sapiens
gcgatctagacctagttagccaagtctctaacgtgacatagggaaagcttgcaatggcaactggccgcccgtctgcgcctgtctctcgccacgcctattgctgcaggatgacgcgcacctctatgaacccgccgtgaggtgtgagtgtgacgcagggaagagtcgcacggacgcactcgcgctgcggccagctgcgggcccgggcggcggctgtgttgcgcagtcttcatgggttcccgacgaggaggtctctgtggctgcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcc

SEQ ID NO: 848 - DNA, 678 bp, Homo sapiens
  misc_feature 417, 515, 529: n = A,T,C or G
gccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacanaaaacaaaaaaaacttaaaattctttgcttgttagtgaccttgatcatggttctctttgtacgatagttgggcatctgtatttccacttgtgtgaatntgcctttaaaattntggtatgggtttaccttttaaaataatcaaacatatttatctcttcctgtgtgataggttctttctgtatcttttccttgttaacacacagaccccttcccaatctggacattgaataaatattcattttcctttgcaaaaaaaaaaaa

SEQ ID NO: 849 - DNA, 2056 bp, Homo sapiens
cgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccgtccctgtacctgcagtgcctctcccagaaactgagacaagaaagaaaacgcccactcctggatcttcacattgaactcaatggctacatgtatgattggaacagcagagtttctgccaaggagaaatattatgtttggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttta

SEQ ID NO: 850 - DNA, 1083 bp, Homo sapiens
aagaagatggcggcggcgggggaagcagcgatgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacatcaggctgtggatacactacctgatggacaagaatatcagagaacttgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagctagctatgggtccatcgactggcagtacccaggctctgaccctcgcttaggatggcacgtcctaatgtggaggcggacagtatggaaaatgatggtgtctcacggtggtcttggacagagggagcgtacaaaagaacgagaaagccggacaccatgggaatcattacgagctaatcgacaggatggtgggcgatgatcagtcatctcccacagaagcactggtccatggccatgccaatcagcagacccgaacagagcaacggcagaggaggcaagaaaaaagggtgaaatgccacacagcaagataagcccaggacttgtaccagccccataaagccacagacccatggacaaggagcatgtgactgatagcccttcccaggacaacacgagaagtgaagcacgatgcagcacgcaaaagagagcccagggcgataaagcagacggaaccgcagagatggcaagaacccggcaggcacacgggaaaaacacaggatggaacggaaagacgacacaccggatgcgaagaacaacagtaacactgggagaccgcacaggggaggacaacagcgaatgaatgtacacaagccgggaacaggaacgaataaacacatgcagcgcagacatatacaagaagaggataccccccagagaaggagaagaaacacaggcaccagcgaagag

SEQ ID NO: 851 - DNA, 2906 bp, Homo sapiens
gcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaagtttctcctttctgtgacttcaaataagaactcccagtattgcctaaatcttctaggcaaccctttttccataaggaagagcatggagtgctgtggtcaccagtaatcattttcaa

SEQ ID NO: 852 - DNA, 125641 bp, Homo sapiens
gatcttgattattcaccttgactatctataatactaacttctattatttaaatgactgattaaatttgaatgtgaattttgagattcttaaagcagtcgtaatagaatggccttgcccataattggaatatttaaaccatagcagacctaaaatgaaccatctacattttcccattcatccctggtacttggatattaacctttggtggtttgcagacaaatatttcaaagtaaaaattaaggaatttttcccaacaacaaaatatgtattaaacttagcagttattaaactaaatcatagaaagagacaatgtttaacacatacagtaaatccttagggggcacacagtcaaaatagagaaacgagagaatgcaacattattaacaaccaaaaaaaaaaggcaggaagggtatgggggctaacgcctatgatctcagcactttgggagactgaggcaggtggatcacctgaggtcaggagttcaagaccagactagccaacatggggaaaccccgtctctaccaaaaaaaaaaacagaaaaattagccaggcgtggtggcacactcctgtagttccagctactgggtaggctggggtgcgagaattgcttgaactggggaggcagatattgcagtgagcatagattgcaccactgcactccagcctgggtgacagagtgagaccctgtctcaaaaaaaaaaaaaaaagaaaaaaaaacagtacataggaaagccaactgagtgaaagtgatagcatgatagtgctaggacagttacagtttaggaaggcttaatgaaaaggatgggactttttattattataatactttgagttctggggtacatgtgcagaacgtgcagttttgttacataggtgtacatgtgccatggtggtttgctgcatccatcaactcgtcatctacattaggtatttttcctaatgccatccctcccccagcccccccaccttcctataggtcccggtgtgtgatgccgccacccctgtgtccatgtgttctcattattcaactcccacatatgagtgagaacatgcagtgtttggttttctgttcttgtgttagtttgctgagaatgatggtttccagcttcatccatgtccctgaaaaggacacaaactcaagggatgggacttttaactacacattgaaaagtagatcagacaaatgaggaaaattccagatgtgacaaatgatgcccaaaatgattcaggaaaggaaatgcataaaaagaatccaaaggtgcaagactatattctcttcacctttgagttgaaggacccagctcagtatccagcacatagtgaacaccccatacatgggatttggattgtaaatgacacatacatatgataaaacttgttcctaaacctgcttgacaatctaggaacagaaacatctcatgactcttgtaactaaacagctttttcaccaactaaaatatgatccatatccaggagaaagtcatatctcagagctaagaaaactaagttcaatagttttcaataacataggaaagttactttttcgtgtctataagaagaattgaacaagcatattatccacaattttagaaccaaaaattctttgttcatgaagaaataacttttactctcaaagtctactaacctttcttctttatagctgccaattcttgctcaattctaaggcagatagactgtgtgagttcaaaagatatcctctgaaaagcatcaaaatcttccactgtgaacacatgggtctctgcaggaggagaggcaatagcttccaattctgagcgaacggcatccttcacaccaactgcaaagatttcaacatctgaattcctcagttttatcgcaggatctctgaaagcatctgatgatttcccatccgtgataagaatcatgacctttggcacattgcttcttgatcccttgctaggcacaaatattttctctctgacataagtcattgctttgccagtatttgtagatcctcctctgtaagggaaggtgtttattgcttcaattatatcttcaactttggtgaattttttcaaagtgaactcagtatgaggatcccggctgtattgcacaagactaatctggaccctatttggtgaaatttcaaaactttttacaagaacttccaaaaaggctctaactttaacaaagtttgcaatcccaatgctataggagccatcaaccaaaaacacaatatcggcttttatatccacaccacgtgagcattctgtaaagagaaaaaaagtacattaaacttcaatacatattaatcattaaaatatacatatctagctttcttagtaagcgtgcttctttaaaaaaaaaactattgcaaatatttcattcaaaactaagtccaaacaagtaaggcattctgtcaaacagatcttcacatattccaaatacaatgatgcacacattgacttacccacttgaactttcattggctgagtcttctccattattgaaatgggttcactggatgtcattcccttcatggcggaaacactgatctggtattctgtgtctgctgagaggtcgcgaacactgagcgtggttgtctgaggccccacactcagagcgtgctgtcggcttcctgcagtcattggtgtgaggatgactttgtagccagtcactggactaggagatggattccaatttagcttaacatattttgaagagacttccatggcaatcaaatttgaaggaggctcaacaactaaaaagttacaagcagacagtgattaataacagtgagatgtaaccttactaatttggtctttaggtttggaccttcaaatctccttattcaaattcatcctaaatacattgaaaagagttgcccaatacccgcctcagtccccaatttcacatgtccctatcaaaccaaaagtggttcaacacttggcttttagtcaaattgctgagaagttaatggaataagaaagtatttggaagaaattaatgttgggacacttcatgcctaattcttctctgaaaccaagatttccattctggttttggtattcactcattgtcttcattctcaagcaccaaagtaggcacttgataaatatttgttaaatcaatgcttcattcaattctttagggaatttttctctcttaataacatcataaaagtgtaatctttaaaagatactttataatatgccaagaaagagaaagcatttagtacttcttaaatgacaggttcttataattttaaacaattttattttcactagtttcagggtaagaaaaaaagttcaactatgttcacagtgccaccaaacagaggggaaacaatggcttataacatgcatattaacgcatgcatatcagtcctctaaaaaatggtgatccttactcaacatagaacatagtcatgtatttgacagttaacgtaaagtattttaagatatttcagacaatatcaaaattctggatttgtcaatggaatcaacttcccggaagatatagttataatttttcacaaatcaacctgcaggaagtgtgtgtaaaaacaggcccaaatttacacatcgcctcctcaaaaaagcaaccagatgtaggacataaaagtgatgtttatactgaataggcaaaagctggaagcatttcacttgaaaaccagcacaagatgaggttgccctctctcaccactcctattcaacatagtattggaagttctggccagagcaatcaagcaagaaaaaggaataaaaagcatccaaatatgaagaaaggaagtcaaactatccctgtttgcagatgacataatccctctagaaaactgcaatgtctcagcccaaaagcttcttaagctgataaacaactttagcaaagtctcaggatataaaatcaatgtgcaaaaattgccagcattcctatacacaacaacagtcaagctgagagctaaatcaggaacgaaatcccattcacaatgggagttgtgaataatagaataaaatacctaggaatacagctaactagttaggtgaaagatctctacaaggagaactacaaaccactgctcaaagaaatcagagatgacaatggaaaaacatttcatgctcatagatagaaagaatcaatatcattaaaatggccatactgccaaaagcaatctatagattggccactactcctattaaactaccattgagattcttcacagaactagaaacacctattttaaatttcatatggaacaaaaaagaatccgaatatccaaggcaatcctaagcagaaagaacaatgctggaggtgcaggctatctgacttcaaattatgctacagggctgtggtaaccaaaacagcatagtactggtacagaaacagacacctagaccaatgttacagaatagagaatccagaagtgagactgaacacctacaaccatctgatcttcaacaaacctgacaaaaacaagcactggggaaaggaccccctattcaataaatggtgctcagataactggctagccatacgcaaaagactgaatctggactccttccttagaccacagacaaaaattaactcaagatggattacagacttaaatgtaagacccaaaactgtaagaatcctggaaaacaacctaggcaataccattcaggacataggccctggcaaagatttcatgacaaagatgccaaaagcaattgcaacaaaaacaaaaattgacaaatgggatctaattaaattaaagagtttctgcatggcaaaagaaactaccaacagagtaaacagacaacatacaaaatgggagaaaatttttgcaaactatgcatccaacaaaggtctaatatccagcatctataaggaacataaacaaatttacaagaaaacaacacacaaccccatttaaaagtgggcaaaggacataaacagacacttttcaaaagaagacatccatgtggtcaacaatcatacaaaaaaaagttcaacattactgattattagagaaacacaaatcaaaaccacaatgagacaccatctcacaccagtcagaatggctattattaaaaagtcaaaaaataacaaatgctggtgaggtagtggagaaaaaggaatgcttatatactgttgctgggagtgtaaattagttcaaccattgtgaaagacagtgcagcaattcctcaaagaactaagaacagaaacaccatttaacccagcaatcccattactgggtatatacccaaggaatataaatcatcctattataaagataaatgcacacgtatattcactacagcactattcacaatatcaaacacttggaattaacctaaaaccctatcaatgatagactggataaggaaaatgtggtacatatataccatggaatactatacagccatgaaaaagaacaagatcatgtcctttgcagggacaatgatagagctagaggccattatccttagcaaactaacacaggaacagaaaaccaaataccacatgttcttgcttataagtgggggctaaatgatgagaacatatggagacatagagggaaacgacacacacactggggcctattggagggttgaaggtaggaggagggagaggatcaggaaaaataactaatgggtactaggcttactacctgggtgatgaaatgatctgtacaacaagcccccatgaaacaagtttatctatgtaacaaacctgtacatgtacccctgaacttaaaagttttaaaaaatgaaaataattttaaaaataaataaatatatatatatatatatatttaaaatgatgtttaagtagaaaatagtaggagggaagccacagagatgccacatggaaatctggccaaacctgagggatacagaggcagtacaggctagtccagcagaagagagaagccttagattagtccagcagaagagagaagacactaaagagaaatgtgaacacctgtgatgtagccccagccccctacacagggaaagttccaacagtggcagaaaaaaagtctggcctacccttgcatacatgcaactgcaccccaggaagaattaaactgtttaaaagactgagtgaagagaagtaatcagagaaaagtggaggtgagtgagatggattttataataatacaaagcaaaaaggttagacagtagacagtaaaacaaaggatagattgagagcccatgaagtaatgagaggttctgagacagaattagggccaatgaacattttgacaaaatgttcagagattgaagattaaagagtttgtatgattgaagatgtcactatttagaatttatgtttaatcacttatcgattctcaagctgagaggagaacaatgatggaaaaatataaaggctttgggttgttatttttaatgttcaaaaggatgcttttgaaatgtcttttctttctcccatgtatttagaagtaataactaatagaaatgggagaattttctaaggggaggatcacattgactgatctttgaaatattcttaaaagctttcaaaacattactcagagtataatgatagaaaacccttgtccttagctagttagcagaaacattgttattattttaagttgcaaatgtctttccagcccatcaatgtttaaatcagagtgcaaggtaattaaagcaagtagcagaatagcataatcagatagacattcaatgtacacaaaagagtcttaaagaaaagagtaaatcataacttgtcccccaccaaaaaaattttaagaactgtgcaatgatacattttactgaatgttccactagaaggaaaaacaatacaaatggtatcaacaagttgagttgctaaaaaacaatacagtggagtatacaattgtagaatcactggaagaaatatttaaataaatatgtctacttctaagataactataaatactcaaacaatggaaaagactaacacatggggaatgctacacagtctactcaccttcttctccactaaccaattcaccaagttgttcatcaacacctgagcacacctgggagatgatctcattctgaatatccacaattgcatcaaagttggccacattgaaaacatggttcagtgaaggtgtggaggcaatttgtttgagttcttttgcatctgcagctttaatgccttcaaaacaaaaggataaggacatattgaaatgggaaatgtgccaactgacttggagaagttcttcgttttctccatctttcacaactgaagacatattcaaatcgtcattaagtcataagccagaattgctttgtttcataacagttgcacatgcaactgtgcagatgacaaaaacattttgtaatttgacatatagtggtcagccaaagaggaaaaaagtggttggttaaacagagtgggctttcatcccaaccataccatcgtatgtctttgccatctgtaaagataatacttttttcttccagagtcctcaataagctggagccctctgaattcttcaagtattacataatataggaaacacataaaaaacacttaatgataatacaaggaggatctttattagaatcattggcccagcattctttgaaaagtagagagctggcaaagaatgtgaataccaccttcctaaatacatatgctaagggagttatatgagggaaatagataagcagaatttttacttaaagacaatttaagtctttaatattacactataaaaatgcagtaaacacttctaatagcatccttccttgaggaatcaatctttcatcttcctaaacattaagtatactgtaggagttgtaaaatggaaataattaactgaacttaacctacccaaggagaaaacttcaactccaacattacgaagctctcttgctggaatttccacttcatcctgggattttccatccgtaataataattgccactttaggaaagccaactcttgccccagcagattccgtgaaagtatttttaactaaataatcaatggcatcccctaaagggaaaagaaacatgttcatttactctgtactacacaatttttccaaagtcaaaaactatgtgaacaatgtcaaaaatatttaatatgtaataggcaatgcatcatttctttctgaaacagacatttcatttatttttaactttaaaaaaatctgtagaacatacctgtcattgtgttgccacctttatatggaattttttttattgcagcaagaagttcatccctttggtagtactgatttaagttaaattcagtcctggtatcagagctgtattgaacaactccaactcttgtcttctcttccccaatgtcaaaagcagacacaagagcagcaatgaagtctaaaatgtacttgaaattatttcttcccacactccaagagccatccacgaggaaaaccaaatcagtccaggcactgacagagcattctgaaatacatttgatatctttttaaatgatgctttattaaatcaactcatcaatacatgttaacattgcaaaaatgttggctccttaaatcattctgttcattagaacatattcaccaattgttcttcacccacatgcacaaagaaatatacaattttactaacaacacatagaagcattttcaatgcctttatcaagatgaattcatggaactagatgtctttaaattgctttataagacattatacaaaaagagataaatagatctataatctgctctccgggagcataaagtccaagtattcgtgctatcaacctatccatttttataaactataccctcactcttctttacaagtacaaattttataaaacatttaggagtcatacaaaagaaatataagcaaagggtttttattccttggtatttatcaacaaataaatacaaaataattgctgtaccattcaaggaagtgcagttgagttgaagacctaatttgttaatatactcttgcacttttcaatataattgtctaaagtttgcattagggttagtctagagggctaagggagcctgatagaagtaaaaacaagcataaaattatgcaaaatagccaaaatatatagtcctaattatcaatatatttaaatttgacaattaaaacctacttttagtgaacaaagagggtaaacaattatttttattcaaaagttaaaaatccatgtggtatcctgaaattatcaaaatacaatgatcagcttttgtaactgaatatgttatctttccttctctctatggtggaggtcaggttggttttatgaaaatctgtatttgtaatgcaataccaagtgaattttctgatgatgattttgttcttgcagtcagctgataggtaataaaagaagtatttggctaggaagagaaggagagggtgctgaaaaattttgcaagccaaataaatacaagttgtatgcttaaataagttttgcacactatttaataggtgaatttaagcctattaaaaagtcaatacttggcataatacctcaatttaaaataaataataattgttgaaaatattagcatctgaaataatgataaacagtgatctggaggggatacttccagataaagagacctttgtgtttataatctttttattgtcattctgggtcataaatccaagttttacgagatgacaaaattagaagtccaagaaaccccttaaggatctatccccataagtcagaaaagcaatataagacaaaaggaggctaataactgcaagatctagactaaataaaattgctttcatctgattacaaatgcaccaatttataagaggtgtgttacagagactctcaaaaaggttacaactaccatcaactaaggccatgtaaataacctagagaagagcataacatacacacagacttagaaaagtattttcatggcaattgtattactttgaacactagctgagggcatccctctcatgttccagccctgtatttctcatatattcctaagtaccacctactgctatcagtttgtctttgagaaatgagttgagtcctgagatgtgctttgttttcacctattgccaaaatcctgcaggaaaggttggacacacacaatttcaaaacactcccattgaaaagaatatctagtaaatagaatgaaaaactagctagaatgtcagaacttaggttataatgacttagttatacattattcttatattgtctgtgctccttccagataaagcttatataaattaatataggaataagatcaatctatgtatataattggaacatctgttctatcctacatttatgacttccatgaatctaagcaaaaatagtaagagaaacactcactttgtatctcggtttttccaggtttcttctccactggctttgtcgaactacctgtttgaactaagttaaaactttattattacaaaaggaaatgaacccaagcagatattctctttaaaatagaataaatatattatattagtttttgttattgtctcttaaatgtatggctctgcccagctggtcatagaatactgccaaataatcattcccttacaagtaagttattttagtgatatttttgagatatttcaaaaagatattcacattgttgtccagcaaagtttaacatttttaatggtcttcattcataacattcctgctgtttccagagaccagagttataaatcaggaatgaattattcatgtccactaataactaggataccagaaaaaaatagttagtactgctgtaaattaactttgtatcataaaagattaaatctgaagttggaaaaaccttctgcaaaataaaaattatacaaatattttattttatatgtgtgcttacttgttagttgtcctataactggtacactttcttctacttcatcatatgaagttattgtcaccacatactctgtttcaggtacaagttctgacaataaagtttcagtggtactagctgaaagggtaaattctttagtaggcccatctggaaatataaaaaggaaaaatatgaatgcaacaaaacatttttcacatataacacaatacattgtaattcccagaggtactcaaaatctgaaaaattcagtatatacattttttcaggacactcaaacattattttttactgccttccaaaactaaaattttgaattttagaaatttaataaatggactggtattgcttttatttgttacaatcatatttaatacttgtttgagaattcaagacatttctagtttaaaggtataccagaatatcgaactaaaaatctttcattggttttggagactaatggtagataacagttttataaatgagagataaagcagagaaaatgaatttaattttaaattatgcattggaggagagcagagagagagaaataagagatgaaaataaactcaaagaaaacaaaccccataggttaagaccaacccctagtgggaaaaaatctgtgtggaagcagtgcatattccatactcaaatggctacatgccttaatgggtaacattgacctctgcattgacttaagcaggtatcaaatatttcaaggtccagtatactaggtgtttacttatattttggcagttatgtactcccttctagattctgttaattctcaattcaatcaggaaacctggtggttcctgggaattacgtgcctgatatttttaattatattgttttcatcaaaatataaataattaggaaagataacaggtgcaacagaccactgaaaaatgctcttggtttgcaggtagaacatgcaaaaccaaccaagatccccagaggacatcaagacactcagactctgccaggttgggtagccccagtgccagttttggaagtgttaggtgtcagttattcccaacatctagaaactggatggaccctgttagaactgattttctgatttggaatgaatatgttaactgcaaatatatttggggagaaaagattgaaagagaaaaaagtaaattttttacccctttttaagtttttaaatcatctttttaaaaaaagctacgtttcctggtaaatcaatatgtaaaatcattggtatttttaaaggctaaaagataaataaacacagttctagtaataagttgtgttgacatcttccatctctactgtcagccagtcaagacttcttcctaccatttagccaatgttagtggaagtagttattttctttctttgttttttttactattttttaaattatactttaagttctagagtacgtgtgcacaacgtgcaggtttgttacgtatgtatacatgtgccatgttggtgtgctgcacccattaactctttacattaggtatatctcctaatgctatccctcccccctccccacaccccatgacaggccccagtgtgtgatgttccccttcctgtgtccaagtgttctcattgttcaattcccacctatgagtgagaacatgcggtgtttggttttttgtctttgcaacagtttgctaagaatgatggtttccagcttcatccatgtccctataaatgacatgaactcatccttttttatggctgcatagtattccatggcatatatgtgccacattttcttaatccagtctatcatcgatggacatttgggttggttccaagtctttgctattgtgaataagtgccacaatgaacatacgtgtgcatgtgtctttatagcagcatgatttataatcctttgggtatatacccagaaatgggatggctgggtcaaatgatatttctagttctagatccttaaggaatcgccacactgtcttccacaatggttgaactagtttacagtcagtggaaatggttattttctcattccattttagaactaaaaattaatcaatagagtttggttctccacattttggcaacattattaacactaaagataatgcctgagaacaagcaaaacaagttttgtttagttttccaaggattcagcctagtgtcgatggaatccacctagccaaagtaaattcttatctgtcatcatggttgtttaccattatcacagaatggtgtttcctggatactgaaatgtgtaggacactgggtaaggtgtaacaacttacttcatcagctgatactttaaatgttgaaaatattaagtaattcaagaagaatgccaaagaatgaggatttgattctataagatcaaaggttactaacaatattctgatcaggtaaaaatagagtcaatttttaataataacaacctaccacagcaaaacatgttaaactcaataacattaaaatataatagtggacactagactggaaatctgaaacctgagttcagcaaatgtctggtgacatggatcaaatccctcaggcttcctaaagcacagcttcttcatgatgaaaggggagaagaggtggagattgagttatatcatcatgatgcttctgtcctaaaaccccagtctcaaaacttacccgttgtagggtccaccgttattctgtaacccacaattggatcaactggttttgcccatgacatatgaacagtattttcatctataattttaaaattcaagtctgaaggtgggtcaactgcaaaagagagagtttatattattaaacttttcaatgtcacaaaatggtcaatttaattaataaagaattgtgttgagcaaagctttctaaaattgtctttgcataaatttgtttccaacaaatataaaagatatgttgttggataagaataaaactaaaagctgacaaaacatcagagagtgtacatattacagaagacagcacaaaacacttttgattcttgagttgctaggtcattcaagaatggccagcaaaatcaagcataatagaaacatatttggatacaagtacatacaagtacaatgaaatcacatataataaccacatatgcaaacaattcacataacaattaaaggaatttcgatacatgctgagtgcattttgaacaagcatgccaaatcacaacctgcttacaaccagagaagttaattcaaaacattgacataatatgttttttcccacaatatggacaagaaacaatgatggttttggttcattctctgcattatttgccttgtaattattcattgttatttgataaatctcaatatgtagcagagatgaaaaatatattttaatgaaaataaggaatcatgggaaagttatatctgacaaggaaatatacatttaaatgtatattcatattcataggcaagtattcaaaaataagtgatgttaatttataaatatataaatagcgatattcaaaagtttattaaactaatattctgcctgtttacaccagcttgctgaatgttccagggtgtaaaccaacactattatttcctttgcagcaggtatactccatactagaaagggcattttagattaaaatgccagtatggtcctttacaaaacaatggttaattatgaaaagacaacatcaatgtatatttatggacatttatttacagaacttaaagaaaacagtgaagaaggatcagtgatctgaagacatgactgcgcataaaaacttggaaaagtcaatgacaggaataactgaaaagtacagaaatagtttacatacaaaactgtagagcatcatgcatgtgtcaatgaaatgttgacttgtttttagtttcccacaatgaacaaaagcctccatgtacagtagtcattacacaaagacgtttcctaaatattttataatgatattctctctacaatgttcatgcctcatcatgcagcattgtactgactcactgtcagtgcatggttgatgaattaaaaattattactcttgaaacaggtcaacaaattaagatgactttcagccacactcttcttaaaatgttttagtctgaaagtattccttgtgagtcagaatttttgcatctgttttgagagattacaatttcctttcaggttttttcaaaggtcaattaaaatacactagcagctttgagacatgagtcacagaatttaactggggttaaagatttatgtaatattaataatatgttttaatggaaataattaagcaaacatttgctttagtggactgctgcgtccaactgtaggagatggctttttatttttattggatacactagtattggaatgaatgttatattcttactatccatacacaggcagtgagattagactattaatctacatgcatagtttaattactcaacattcttcagtctttaatcatattttgaggtttagctgtactcatcactcagtataacatgcatgcaacagatgttaataggacaacgggtattaagaatatcattataaaatattgttccagtagcaatggctcaggacaaatttaatgcaaaggcagacacactggcctgagcatgcttttaaaaaaaatcagtacatggaaaaacagtaccaccaaccttggaaggaaaatgacctgaagcagcggacattaggttaaaactgctgaagggcagtagcagccccccttgttgatatccaaatgaccaggattccagataaactgaaaaattgactgtggggaaaagtctttaacatttcagaggatcttgaggtgttcatagaaactgtgatatgtgagaatcaaagtagaaaagaatggccaacccgcatgggtacaacagagagcccgcttcacttttcttctggccgattttattgcatgtacagcttttcaggcatgccattctatttgtacatttgtttgtttcatgaaaaaataataataaagcagatgtaagtgtatgacccgtgtcaacataaatcagtgctgaaaaatgtactttattaattttaaaaatattttcttttacataaaaataattcataaacaccatcacatcatcacagagtctaagtgttccctaagacaatgctgatgctggaaattttcttttcttttcttttttttttttttttgagacggagtttcgctcttgttgcccaggctggagtgcagtggtacgaacttggctcactgcaacctcagcctcctaggttcaagcgattctcctgcctcagcctcctgagtagcaaggattacaggcgtgctccaccatgcctggctaattttgtatttttagtagagacggggtttctccatgttggtcaggctgctcttgaagtcctgacctcaggtgatccgccctcctcagcctcccacagtgctgggattgtaggaataagccactgtgcccagcccggaaattttcaattatgcactagctgcatattgattataactgcaaagagccatagttgcataggatgagaatccaaaccaagagaaacagaatgaaaattacaaataaataacaatcttacatatattcaaaaaacctgaatactgacagtaaagagactaaaattttaagtatttttattcttatagtttaatttcatatttacagataatgttttttgttatcaaaacgctatgctacgaagactcattctgatgaaatttttgttacataaactggcaggatttaggacattttgggaatgataataatagctgaaacttgctgagtgttctctataacaggcagagagctggttactgtgttgctgcttttttccttataagaacccaatgatgggccttattatccctgctttacagataaatcagtgaaattcagagagattaacacagccaataggcaacaacacttggattacatggtctgactacaaaacatacagttttctactgtactagattaaatgcaaagtagaagaaatatttccatcaaaaattaactttagaaaacaatatttatatgtagttacttttaacccatttatacctgaggttgcaattttttgaatttttgtaatcagaccttggcaatgaccttgagcagtaggatataaatcactcccacatgcttagcattccaatagtggaacactaggcataaatgggtttaatatatacgtatttttaatatatacctatatttgtaaatataagcaatatttatatgtagctgatttatatatacatacatgtataattatatgtgcatatattatacatattacatatgtattacatatgtaatattgttattacatattacatattattatacatatatacataaatatgtggtattcaggtatctccaattcagatatagatgaaatttggtatattaactttatacacttgttcaagcatttaaaactaaagtgtccatcttgatatataactttttgaaacatttttaatagggcacccaaaaaggggctatgtccaagaaattaccggccactgcagagatgaatgaagggaaggatggatagacaggtgggaaaatggatgagagggagtagaggagtctaataagttttggtaagtatacataatgcgctatagatatatcaaaactaagaatacactactaaaatatcttgatgaactactaagatctttagtttgatatctgtgataacaacactggaaaggatactaccttaataggagaaatcttgacaagtgtgcaataagtgatgagttaactatattctataggcattaatttacatttgccatgcaaaattagcataactttaattatctttgccatgatatagaaatccatttcatttgagttttcaaggtaccataaataatcagttgaaaaaataatattttagaataagctacagattattttgtacacattacaaaacatgccctctcattaaactttccggatcaaccagttgtcaagcacaaacaaagcacagtgtgaccaaaccagcactaacctaggactagaagactggggtcttgtctgtttttcatatctaagtaagtgcattagttgaccaagtgattcagcctctctgggcctcattttctcatttggaaaacgagagaagtagaatagatgatctctatgttagcctctagtttgaaatttctgttataacacaaattagacataggattataaaaatatatacaaattagtctcaacctagacacaagacaaagctatagccacaactcaccgatgaattgataatattcaattgttcattatatattataaactataaatcagactaaccaaaattaacactctgtttttcagaaaacttgtattcatctctaatcctagattaattagaaaagtgcccagttctcagggaatactgaccattaatctttatatgcaaagtgttaagttttctacaggataattaacatactgtatcatacatgaaccaaaaataattcatacattctaggccactcagatacagttgataaagtctatgcagtgatgcggttgataaagtctctgcagtggctaaaaattatagatactgaagtgaaaaaatcatttccactcttatttctataggacaagataacatagtatgaaaaatatagctcctaatacaaataagcagaagaaaaacaagacaaaaatattaccactataaaaaagaagaaaggcaaaaagtgaataccaaaacattttaatgttttcaaaaaggtattgggtttttaatatataaaacattaaggtcatagaaaatggtaataaaatagtatgaatataagagtgcaagtgtgagtcatgaaaggaaaagaaacgtaactgtggctactttaggactcagatcaaaatggcatggtaccaaatggagtcccaagttgaaattttgaaatgcccccaacagaaatatttcaaagaaattctggttccagcccagtgaccccagaaaggctttggccccaaattttgttagcccttcaaaggcccctagcaccacttagtagtcaacagcagagctgtgctgtccgacacggaagcaaccagacatctgtggctagcaagctcttaaaatgtggccagtacgaaataaactgtgctgcctgtaatcccagcactttgggaggccgaggcaggtgaatcaattgaggccaggggttcgagaccagcctggccaacatggtgaaaccccgtctctactaaaaatacaaaaattagccaggcatggtggcaaacccctgtagtaccagctactcaggaggttaaggcatgggaatcacttgaacccaggaggcggaggctgcagtgagccgagatcaagccactacactccagcctgggcaacagagcgagactctgtctcaggaaaaataaaaataacttaaagaataaattgcactgtaagtataaaatacacacccaattgtcaaagacttagtacaaaaaaagtcaagtatctcactaataattttcatattggctccatgatgaaataatttaggttaaataaaatacattataaaatttaatttatcctgtttctttttccattttgaatatggctaccagaaaaaaatgtaggttacatatgtggcttacatttgtggctcataccatatttctatttgacaatgccaaactagagaataaggccaaaaaatgaatcctattaaaatataattattaaatactaacttaaggagatgggatacaagaaaagacacagattaagaagcaaaaaaaaaaagagctgtaccatatggaaataaatacaaatttaaaagataaaatataatatgggaataatcagaaatgtagatagtaagctgttctttctaactgcactttgctaaccagccaatatctaattcagaatcaattttttccacttacatcatttccagcctaactctttttctaagaattctcaactctttctgattttcaaataactattttcttaatgagcaataaatgggccacttcagtgaattatctaaaaatatctgtagtagggcctccagaagttcctcaaataaaattccttcctaacaacgacatagaaaggaacattaaaagcaacttcatctgactattacttcacagaggccactctgaaaagcctctacattcataaaatattcatcagctaagaaaagtcagcaagtttctgtcacttttcttaacatgccatacattttggaaacactctgcttcccctaattttttttttacctgtagtcttgaagtagaaaatccaacactatagaaaccttgaaaaccttggcataatcatgcaaacaaccatactttctcacagcctctaaaaaagcacacctcaacccagaacttccacagctgtcacttggcagaagtgttttttttcctcccttaacttcatcaggggtatttctttactgaaaaaaaaaaaagatatctttcatgacattaccccattttctttgcagaataagaaaactaatttgtcaggtctccagtgacaactgaggggccacagaagccgccatggggttgacatattgaaatggcttgtttaatgaacactgagaaattaagacatcaagtgcacacaacaaataaaattgggtgggacatctaacaaaagccctccattttctagaggaggggccacacggcgccgttttggaaacccatctcggagcgccccactgcctccgcgggaaggtccgacgcacccggctgtccctgagggaggcaggatggagcaagggcaggacactggaggtggtgcccagcaactccggcgcgcgcttgcttcccaggctggaaaccttggcccaggctcaacctgtctgagctggaccagtccaggccacgcgccttggagccctgctaaccaacagggacagccgcgaccctaggtcgtgcgaacacctggggtcccggatctccgcttgcctgccatcatcccccaggctgcttggctgctggctcatctgcccgcaccgtccgccccgccgactgagctccccacaaagcacacagaggcgcagagccagcgctgttggagtcttttattgtgttctgtcaccgaggtcgcagccccgagccaggtggttggttaccagccaagcgagcgagtgcgcccgctcttcggggctcctgggtgccacccggaggtgtcctgttggttgcgctgattagagccgtcgccccctctcgggcggctggtcctcttattaggcggcagtgcaggtggcagtgtggacagcacaccgcagagacaagctcaagaagaccacacagcactgtacggaatgcattaagcagaatacgaaagagctggacctgagagctgggaaatggacaaacctcaggagaaaggggcgtttctctgaaggagagaaaccaccggagaaagcacgaagcgcagggaaaacagagcaagcaatagaagcaagaaagatgtgttttttcctttctcgaattttgcattgtcactcggtgaaggggaagggagccttttaccttctgcctcaatggaagacaggagcagggccgcgcccagggcggcaagcgctgggggaagcctactccgcatccttggcctccgagcttacagcggcatgaagagatctgcgggaggaagtagtgactgcatcagaactgggtctgggcaggccttgaaccaggttagaactggagcctggacctagtccagaacccgaccagatctgccttaaaaaccacagggcctactccagcacataatgggcctattgtgaagcagtggaagtcaagttcgtctacagaagtttaatcatggccctaggaggaagttcaagtttaaaaagggtcctgttctcctggagactggtcctgcttagcatcccgggtgaaggcctttaccagccctcacatgacttcatcctgcctgggtaatggctaattcagaggtcattttatccctcactcaactaaatatctcttccagctggggattttatttgactgcttttttcctagctgatgaactctttaggtaactgtactttagtggtctcagggtaatttggaaaagtataataaacctttttaattctcttttttcttcattttgttctgctttcaaatatgcagctctttaagatctgaaatggattatacagaaatatgtaaggcccagctgaaacctgaccctcctgctaactgtgttgttttcacatctgataaatcctttacctgagatgagggaaaaacaactccaaaatacataataacaaataaggcagcaaaatggaagaagcaagacacccttgtctgtttttccaacgtgtttttaaataaaaattatcaataataatctttgtatttaactgtttatttaagctggaagattattagtatacataccccagaggagaatatgttctgttccgattttttctaattttgtaattacattatgaattccttaaagacaaagaatcttattcatctttgtggtttcccagcacacagtaggtacttaacccatgtctacagaatggaatctcctaaaatagtctagggttcaacccaaagacaaaagctactagcaaggaactgaactgggaagttgccagtggcaaaacataaaaagagttgactctgaagtacataatttattgtaagccaacagcctaggcctcaggaaaaatggagggggataggagactgtcctgcgtcggaatgcaaaaatgagccaaaggtcgaggcctctttgagaaaagaaactgacaatctccaacgatgactttccaaattattggcacaaagcatgagggcagctttcctcagcctgtgtgtaaattgcattttaaatgtctgatgagcaggcgtgccaaattgcctggagctcctttttatgaagccaagattaaaattttggcactgccctaagtatctaaggggtctagcaatttctttcttcctaattaacaactgtttgacatttctaaccctcttctacatcagtgaaaagcaagaggtgagactggcccattgttccaatcatcttgccttaactttggtataataatttccaactcagttggcagtcgtgctcgcgagaagttaaaggcgaacaatcgacccaccgaaaagctgtgcgcagatttttttttaacagctgaactcaacgaaaacctgagtggtaacacttttgctgggtctcgatcgccacctgtcgctttcccgacttagctgcaagaatgaatcatctcgcgccgggatatcggaacgccagccagccaagcatcccgtcaatatatgttttaaaaaagaaaatgctttctctcctttttagccaaaacattcatttgaatgcttagcaacacttcattgagcattctcagacataaatatctgaaagcggccgcccctacgtggcagcgaggactccctcacttcaccctcatgaataaaaatgagtccactggggtgggagtgggggctaagtggactcgtccccttctgccaactcgccccctcccaattccctgctggaagaacccaattccttaactcccgcgtccagttaaaaagaaaatcacacacacacacacacaccgcgtgcgcgtcgcctacctcctctcccacccaccacgaccttggcattagccaaaggagagcttagcgtttatttcctttcctgccctatccttccccagcattcactagaagactacagagtccggatcgagagtctccctggcccagagtcccagggagccctgaactggtcactgaagggctcccgaggtcgcccgcttgggggtacctgttccgctcgctgaacgagtccggcgacccacgctttctgatccccacaagtctaggatctgagtgggaaaccgccgcggagatctcacagaccccgaatagggcctccaccaatgcaccgggagggagtcggagaggggactttctcccggagctgggaaaagtccgccaagaatgagtaccctagtgctgcctaacccaccatctcggatgctctgaaaggtaggggaggaaggagccagaacactccactaggaatctgttacgagatgccacacacacccgtgcagcctcgacgagctgcagagcactcagcgggccctccaaagaattccgcaccgtgcgtcaccaaaataccttcccagcgcccccgccgcacgcctgccctccccgacaaagccacagccgcgagataaccagggccctgctgccccagaacccggcgcgccctccattgaaatcgacagcatctacagatgaaactcctctagaaacggaaacactgaacgggatgctttgcgtgcacaaaaccttgctcagctcttaagaaaagcaacattcccctctccctcaaaaaccccaaagaatcaccaaatcccagtatacaaggcaacgctctagcccacctacactattacaagtccaaactgtcctcgcccaggattcttcaccgctccgggcaaggtgcaagctagacgccgtttcccgagttgtctctgggaatgatgggggtaggggaaaggggacagaaaccaggctgacctgaggcggcggcaacagggagaggtagcggcggcgacagcggcttcccggcgtcggagaagctggtgctcggtgtggcccccacacgccccggcgataggcgctgcactccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcgagcattccttcggcgtgaggtggcgatcgccgtagtagcagtgccccgctggggggcggggagaagggagggagcgtagagggggacagccgcagccgggttccctgccaagggaagccgcgtactccgccacttggggcggactgggatttctttaatgaagctcgggtttccctatccctgagatttctttaatgaatttttctacattaagaacaatggggaggggaccgactcccattttcggaaatgcaaggatgcgtaacccattcacccccgctcctgcggatctccatccttcatctgatatcaccacctccatcttcctccccctctgtcctgggtgcacttaaaaccgatttacaggatttccattaactaactgtctgtacacgcggcgcgccttctgtctttttcaatctccaagcgcgattggaaacccggacagccgcccgcgcggggctcagtgatgggatggctttcccagtcctttctcactcccctggtgcttcaggacggaactgggaggcttaagttgagccaaaagagagggagaggaaacctatgaaacccaggagttctcagaataggaagccgctcagtaacaagttgcatccactgcagaaacttctcacccggaccagagcaaaacctggccccgagcggaggcttcggactgaaagctctgcccttaaaacctcgcggagccaaaggggcgaagaggagtaagtttgaaaccccaaagcacccctccacacacagtactggagaagccaaatagggggctgatattctaccaacaacgtcgcctcttcttacagccccctccatcctggcatcctaccccttgttcctgggcagggagtctggtactcagggttgccagattgtacaaggcgcacgggaggaagcttcgagcgctcacaccaagaaatcagaaaaatgctactggagagattctgattataacgtctgacctcagtataggccctgcaccgttttggcctcttgaagcccaaaggttactcctgtaacgctgggggagcgttgaacaacaaaggaccggggtggggcgcaagggaacagaggagctgcttctctggaactaaccgcccgccatagtagaatcggagggcatgttcccaatgtaaatctctcttccccattggctctgacgtctgcaaatttggccttccctctccactaggcgtgatagcctccaaacttgcctttcgactgacaagaacttgtagggcgctcccctttctgcacatctccccacacacaggctgcctccagcagaagccggcgaaagcaagagagaagacaagagggagacaatgaagacaaataggaatcgccgcctctgcacattccccaaccacacagcccactcgaagtccagctgggcagctcgcacaaagagcctacacagtacacaagattttcccccttcaaatcctcacaaccagagtgtctgacaaacccctagtgagtgagcgcgtcccagggatgaaacacccgaccttctcaacgttgcgcccaatcaggcttgcaaccacattgccctggtatcactgagccccgaatttgtcgacagctggcgtctgcacccaagctaacccttcactcgcctccccacccaacacacaaagagcagggagcccagtccaaccaggcttgcagaccgcgcgtggactggtggcagcctcaaagaccgagcccgagaacagagaagtccctcaggccgccaagcgggcacccagtagggctgcgcccttggcctgctccgctgcctgaaacggccagggaagcccccggacaacgacaccccgtccagaaagggaaaaggaaaactgctactttgcacgccagcccaagctggctggtgtttgtatttcggcccagatgttctctctctctctctctctctctctctctctctctctctctctctgtgtgtgtgtgtgtgtgtgtgtgtgtgtgtgtgtgtgtgtgtgtgtgtgtgtgtgtgtgatggcggagttgttgactgaggagcatgtaacactgaatgttgatttgttgttgttgtttaaaagagagaactcttgttgatttggctccgagctgccaatgcatctatcaaccccggagttgagcagtcaccctccggggatccaaagacagtcacgggcttccctttcctgcggctggaggccgcagactgggtggaagaggcatctgtccccaagggcgtgcacattgccctctccagccaagagcagcgtgctggggaccctcgtgggcatcttctcttgctgaggcattcttgttcacatacttagatttaacgtatctgaaaatagttgctgcaaaggagtgtaggtaacacaaaccaccacctgcaaacttcctttctagctcaacaaaaaggatccttaggcaaaacttccagagtaggatgagaggaacaggaaggagaggactcccgggttggggactacacagactcctccagaaactaattcaagtacactcattccccggggacacgagtgtaattcaaatgtgtacaaagaggcaatccggggacctcccagcatgacgttggcattttggtcccctggggcctttacgctagactcctagtgtgataaacggtaaagaacgggtaaccctcttccatccttcccctttcaatggtgcatccagttcctaataccctttggaatccgttggtgatatttattgactggggaagagccagttggatttattccgtttggtagctccctgtggcttttagtcctcaggcgatatcacgggctctgcctccttcgcgcttcctctgttcagctcccacctcttcaccctctgagtcctgggctcccggcggttccgagccctcagatttcttgtccgacagcgctatctagtggtcagcgctaacccggcgtcagaggttaaagttaacagagaacgtagagctgggaagttgttgacaagtttacaagtcttggggtgagtttttaaaaaaaagtctcattcatgtatttgattctcagggctgagaggcggcagggtgggagaacgagtgaggagaagggcatcaactttcttcatgccgtttaattagctgcttacagaaattcctgccccaaggcttctaggctctcctcaagtttcttcaaagaaagggtgagtttacaagggaagagatattgatttcaggaagaagttaatattacagagtgcccttaacttctgtaatcttaacttcttcaaaggcaatgggggcctcttcactgatttgtttgaggtcaatttagccggcattcctggcaacaggtgagacagtttctagaacacttccgttgcaggttctggctgatttgtgcagaaggaaggggaaacctcgtctgaacgtgcagcatttgcctatctcttaaggctggccccagtgtgaactgtgagggtcttgagtgaagaaagctctcacaagccccttggaataaaagggtgaggagaggaggtagtgcaccacctgctctgattctcagaagcggagagacaacctgaccagcaagagtcaaaaactgtgtgtctgaatcctcttctttccatccctgtgtgcaactcaagtcaacatacatttaatgagcaccgtctatttacagtgccaagctcagagtagctgatatgaagataagtaagacaaggccttgccctcaaaattctgtcaagtaacagctgggacacctgaagcaacttcatgtgtgtggcctatttaaatctcccaaggtcgtgcactcagcatgttgtaacattaaaaatgagacgccttagacaaccaccctctctgcactagcaaagcttaggaatcctgagaccaaaccaccctgaaaggaaggaaggggacgtgctgcattcttgcctctttgacaagttctgcttctttacaaaggactttgcaagtacttcacccagaccatctcacctgtaccgaaataacctcccctactagcgaatgagcaactttggagcagaaagcagaaactgcatcatatttctcttactatgcaaactggtagctcaaacctcatatgacctcaaaaaactataattgcttcaacctaaaaaagctgattgtaaaaaaaaaaaaaagctgtggttgcacacacgtgttcaaaaaacacggtatccacataaaataacgtctcaggataaatcattcagatttaataaaagtcaagtactactgggagttgattttccagttagctctgacctccttgagcaaaaagtagaagataaaaggaaatgaattaacttaagagctaagaaaacaaaccgctgccacttcttcctttgtttccataaaattcagtacttttaaatcacaccaccacaggcatcttgcaatctatttgctttggaaccatcaaagtagcataaggtggagaatttctagtcaggccactgttctgtgtgtcagcagtcatatatgtatacttaaatacactttcagattgatggaaaatgtgaagaatcacgggaatctatttttcaagatttggtcttggcttttaaactaattacctagtagattgaaatgcggtaataatgaaatcatagtcaaaagacgtttcattgctctcagtaggagctcctgtgtagggtgacatgtaacctgaccaggtctccatttgataactcgtttttgttttgttttgttttgtttttctgacacagagtctggctctgttgctcagcctggagtgcagtggcgtgatcttgtctcactgcaacctctgcctcccaggttcaagcgatgctcatgcctcatcctcctgagcatctgggattacaggtgcatgccatcatgcctggctaatttttttatttttagtagggagggggtttcaccatgtttggtctcaaactcctgacctcaagtgatcctactgcctcggcctccaaagtgctgggattacaagcgtgagccactgcacccagcctgataactcatttatatatatttactaattcattcagctacatgtatagaatactgacatcggtatatttaaagcagacaagaacccagattttgaaatgctcctaaatctaatgtgattgcgccctctggtggagaagagcaaaaggatgttatctgattagactcactgaatcatttttatccagaatactcgttctgcaaatgctgttactctagtcataatgttaactaggaattgtaggagttttttttgtaaaggcaaaccaaaagaagtcctgcccataagaaacttaaatatagtaataagaccagaaataaacatacgtggaagccaaatatgactcaagagaagtttggagacagagtgtaattgaaagctgaaagatcaatgtgaaaaatgatttgaggaaaaatagatgtatataggaacaagataaatgacatcacaggaagcaatcaattcaacccagaacgtgcaaaattccaagggataatctacaagatttatcctgaaccagttcctccacaaatcaatgacaagaaaaaggaagagaaaaaaaaatagattgttatgaaaaaaataggagctataacaaccaaataataataatcgttatcaataagtatgaaggatctgagattttatcctacttccaagctaacaagttaacctgttgtagtttcatgggtgctgaccgaacacacaaggaatcaaaaacaaaggactgtattgctcacaataatagcagccagtagccagggtcatcattcacaccagtttctcaagccccagttccaacagggcgatacaagaagagacaggtgacccttgcacatgcagtgggttgcattataggaatggaatctgagcttgggatcttttatgagggcaataaggctgcctggcttttgccctggagagacacgttgtttttgttacactggacagtaaacaaacttgcccttcactctggagacagaaatgatcactgtcttccaaagctgttagtatgcaaacacccttgaagagatcatctacagtactggcagtcagagcctctgccaacagacatgcagaaacgtgagagacttgtggagaaatatctcccaacaataagaattgttaaaagtctgtgggagggagaaagcactatatgttgaagtggtccctgaggaatttctagagaaggaagactttaaaggactaggagtgagcattctaagcacaaagttcaaaatgagaacttgaaaaaatagcaaagagcaggaaatgtgttgggcaataaataaagtagagtggttttagcagaatgtttttgaataaaactggaatagtaatggggcttaaaagtggctgagagcctggactttattcctctaaatatagaaataactacactttacagagtacccactgtatttcagatactacataaggcattttgtatttgtcagtccatgaaatttaatttttatctctgtactacagataaagaatttcatgaggcaagtccaatctggcaacagggctcagggtaacttgctgggaagacaacctgcaagcaaggagactggggtagggggtaccagaatccaaggaagagacactgagagtctctgtatggtgctcacagcagcagcatgcaaagagaaagatggctggctttaggaagtaaaaacgagacaatatcttaagatgatggagcaaagccaggtgactgaatgaatgatgatggtgccaaggggaaaattagagaagtgaggcaggtgagccagttgtaaggggacatgacaaaatggctttagacgtgccttatatatgatcaaaatccttggatttttttcctagtaaagtttattggacactctctgctatattaatacaatttgaatagtgtctcaggttcaaatacagatttttttagagtgatatactcttttttttttcaggaaattgcaaaccacgaaaaactactaaaaagacatatttgcactctatgcaacaggcagagttattcaaagggaaaacaatggcattgttatttcttggctctccagcaagcttgttcatgggtggctgaatgcataacactgcatgtgatacaaaaagcatctgggaaatgcttaaacaattatctccagcctccctctatctgcttctcaagtgttagactcatcaagactgtgggacataaagtcctcactcattgtttaaactgagaaaattatttcaaactctcacacaaggtctactttaaaaaaaaaaagtagtttgtagttttacttattgaatagcttattttcttatatttttgtttctttcttgatagtaatagctttaaaatgaaaccactaattgcccccaaaatacaagttcctgatctctgatgttaggaacacataaggccatgttcacatcaagaaagtagagttagaaagccaagtattgaggattgagtttgttttaactaacacacttttttgaaatgaagtcttgtgcctttatgatttttattactactgatgaaaatgaagttgaagtgattcatcttgtactttctagcggtggctaatactcattcagatttttaccctggaactaaagtgagggtctcaacagacaaataatgggtttttccccatatggctgttgtgtgggccctgcagtgcctcaataatactccttccacttttggttcacccacatgtgaggccaccatgtggcttggggtggtgctgacaggtctcaagccagactgcacgaacaaaaatcactaggctagactgagaacatctgaactaatgtctaagggccagcctcagacaattaaatctaactctcagggtggggcctgggcatctgtatattttttaagttggctgggtaatcctgatgctcagtgagggttgacacacattagtctaagccttgtcacccagaagagccagaggagtcatctattaatagaactggcagataagaaggactaatcaatcacttgtaggacatacaggtccccagatcaatggttcaagtgagtgtttatgggtttagcctggccaatagtagttaggaaaattattctgaggaaacttgtaaactgagaggaaaagttgacaggccagggtcataaagccagtgtgaaactcaggcctgtctgcttcccaaacctccaccctccccacttccatgttacacctgggaggaatctagttcattgttgtcattgactttaaggtttatttatttatttgagatggaggctggctctgtcgcccaggctggagtaccgtactgcgatctcagctcactgcaacctctgcctcccaggttcaaacgattctcctgcctcagcctcccaagtagctggaactacaggcacgcaccaccatgcctggctagtttttgtatttttagtagagacagggtttcgccacgttgaccaggctggtctcgaactcctgacctcaagtgatccgcccacctcagcctcccaaagtgctgggattacaggcgtgagccaccacacctggcctgactttaaagtttaaatcagacagaaacatggatacagtttcatttcccaaaggacactcaagatgctatttatttccttttcttactaacattgatgctaaaatatatatccaaagatgagaacattttgctttatttcttctcaggaaatacaggtaatattttctcactgtatttatactcaacagattagttgcatacttataaagaaagcaatgaaattgtgatacacctgatctgatgattatagaaattatcacagtgacggaacttaaaaggatcttagacttcctgcaacccactcccttgtttcacatttgcaaaacctgaatagtgacaggagtacaatccagatgccagctgcctggctcatcttccttccattattccagacaccctattcctgggcatgtcatgaattttgtaaaaacatgttagaactcactgcctccctgtctcaagactgaggttagaatagagccgtggaaggctgccaccaatccaacatatctgcatctgcagtctttcaaagttaaagcgaaacaaaacttgccacaatacgtgatgacatatgccactacatgtgcctggcccacccagcactcccagtacagctgacagagctgctaagaagatcagatgcctcaacatcattagctcctgcttcagagggaggaagagggggaggttgcaaccgtgcctattacttagcagcatcagacctgtgtccacaggtcagtgagtgcaggtgaaagggcagacccggcacagtggacttgtgtcctgtgacaggcaatgtctgctcacttcccaagcccacctttgcatctaagagagcattccctcagtcacttttaattgcccctctcctaagagtgcccaccactggcactcttcttcatcagaggtttctgctactagtaacagaaaacagaaataacagggactaaaattctcatgagaatcaaaaggtaggcagtccaaagctgatccagttttctgaagtcctcagacacccaggttccttctatcctattattccacacatgaggcctcatttcaaggtaccacatggtccaaaatggctgcacccacttcagagatgatgtatgaatttcagcaccagaagaagcaaaggacaaaaaaaggcagggggagagtttcaaatggtggtctttgctgtcttttgaggaaggttctcacaagctgctctttgacaattgcaattatatctctttggccagaacttagtcacatggacccatctaactgctagggagacgtctggaaatttctggccacccatgtgcccatctaaaaatctaaggttctgttactatgcaagaagggaaaaagaataatgactctactactaatagatagaaatccaatggtaaacatctgtattctcctacacaaagcgaaagtttcaaagtgctggggcaggggacagataaaatgatactatttcagagtgattgatgaaaagatattctgacagattaaatgtaaattatgcaatataatgagaggaatgtcactttattcattttaaatgcataccagaattcaaaatgatgctaacaaacattgtgtagtagaggcaccaatgtaaagaattactcctgatatgtatatagaatactagctcagcttacattgctgatacattaataaatccctataaagcacttagaaactgtctagtcagttcaggctgctataacaaaaatactatagactggtggcatccaagatcatggtgctggcaggttcaggtgaggggactcttccttatttgcagatggctgtcttcttatatcctcacatggcagagacagagagagagaaaggaagcaagctctctcatatcttttattttttcatctttttattttttagagataggatctcgctatgttgcccaggctgaagtgcggtggctgttcagagtcacaatcatagtgcacaacagccatcatgtctcttaaatgcactaatcccattcatgagggctctaccctcataacctaattatctcctaaagacccatctccaaatatcatcacattggggatttcaacatatgaatttgggagatgggggacacaaacattcagcacatggcaggaacatgttccctttaagaaagtaaatcttttgtgtttatactaccagtttgtttgattgggactttttttcacggatcccttttttcagcagatagtgattggtcaccttttgtggactgatgtgctgggcacttggtagctaaaaagcaagctaagccacatcgtattcaaggtgtcgaatactcctgctgtctgacatcagttttaataagactttcattggaatttggactcgttccacttagtctgaagaaccagctgccaagcacaagggaatctcctttgcgctatggtcttcagaaattctttaactcctggtcctcacacttagcataatttggggattgcctttacttaaaagaaaaaccatcctgtgagctggatggcctatgaaaagagaaggtccccagaggacaatggggccatggaatcatcattgatgacatcattgcatagacgtgtgttttccctagcgagtcatttactccattaaaaaattcataacaaacttcacttcctctttcctatcatacagggcgttgaaaggattacatggtatcttttttataaacaagcactatgctggaaagcaaagaaggcaaaacaaatacagctataaatagaaagagaatagaggcttccaggaaaatgtaggcgtcttataaatgactatgactgaactgctgtcatgaaaagatgcttgtgcttatcttgtagacaacaaataaatcacaggactcccatatcatctcaaaaattaagaaggctccttctagaacttcaagttcattgaaatgtattgtaaatattctttgacatatcacagaatctgaaactgaaggacacaccctagtcacatctaaagcttcacagtttttttctctgggtctgagatggatggccatagaaaggaatttatgaaggtaccacagattacctactccaaagtgtgtaggatggtttaaggcggcagaaaagagattagaatctgagagaagaatgccattgatgtgttaggtacagagtaagagtcagaagagggttaaacagaagagaattaaagggagggaaagcattttttaattgaccaaataaaagaagacactcatgaaatatatatattgcacttgagtactactcaaggcaatgcccacaatagtcttttaacgcagatggaactaatgttatttcttaagcattccagatttttttaatctgatgtttcaagtggaggttacatgattttcttaaagccacataactagaaagtggcacagctagctctcaaacccaaatctactgccacagctggcagcagagcaaggcagtcttctggttccagtgtcctcccagactggttattcgccatttactgtattcctccctcaccatgtcactctgcttttcccatctttggctctcactcagggacccctccagcccgctgcacctgaactcagattcccatactctgaatggctctttccacacaacttttagcaaggccattgagaaatggtcctgataaactctgatgaagtaatcctaccagagcagcttggtagggactttgaattctaacaagtatttcgagaaaacattacctgagaaaagaaagacactgtaatgaaggaatttgaagtatcactaactaaaaaacagaggagttgcttggaaaggaataaatcctattcaacatctttctactctggcaaccagaaaaagctaggccttagcacgtctgtccatttatttttatatatttaaaaaataattatatctgacaaatagaaaaccaaaaatcaaatatgattatatttatattcattttaaaaatacttatgaactggaaactacagatactgtgtacagatctgtaaattacaatcactttggaaaagtgtagcatcttactataaagttaaacacatactatataacccagaaattccaatcttatatacttaccctagataaatgaaaatatatgcatatataaagacctatatgtggagtcaggtgtggtggctcatgcctataatcccagcactttgggaggccaaggcatgaagatcacttgaggccaggagttagagactcctgggcaatgcagcaaaaccctgtcttaaaaaaaaaaaaaaatagatggcatggtggtatgagcctgtaatccaagctattcaggaggctgagatcaaggatcacttgagcccaggagttagagactgcagtgagctatgatcatgtcactgcactccatcctgggggatagaacaagatcctgtctcaaaaaaaaataatagataataaagaactgtatgtgaatgtttatagcagcattatccataatagccacaaactaaaaacaactctaatgtccaccaaatggatgaacacattgagaccatgcaaacgatgggtactacctagacatgaacaggaatatgaaaaggaataaactactgatatgtgcaacgtggatggatttcaaacacattatgccatgtaaaaaagtcagacacaaaggaatgcatgctacagatgatttcatttatgacagcatagtactggcaaaactataaagaaagaaatcagagcagtgatttttaggggctggagatggggtaggagattgactgcaaaggagcaaatgcaactgttggcactgatgaaaatgttccatatgataaatgtggcgtagttacaggactatatacatttgccaagtcattgagttgtacaatttaaaagggctaattttattgtatatgaattgtccctcaaaaatgtaactttaaaagtgtattaaggaaaaaatgttagagattttttgaatctcagtcctgagaaaaaatgtttaaaaaagaaaaagaagaatttattgcatatttgctgtaaaacagacactctaggaatacaaacatgagagacataattcatgactttaaggagtttataatccaggggagaagagacagaagcaaacaaagccacaatcttgagtaataaatgcatgtagaggtatacccagcaggctgtgggcacacagtggggtatctaagtcagatttctgaaactgacagactcccgaaatgaaggtgcttcagctgagccatggttctgtaggagtcagtcagccagataagagaaggacatccttagctaaggaagtacaaattacaacaacagagataaagatagaattcacggatcagctctagttttgaaaattgccaaaatgaataatgtaatgaatttaaatgagaaaatatacacaacatgacagaaattacattctatggcagtgagacatattaaaatgtgagcttttctttccatagaagtgactgatgagcttgagaatcctgaaaaccaagtttataaatgaacaggactattacttattaagaataagcatttcttgctttagcatgatgaccaaggatcttcagtgactcaaggatgaacagacttcactgatctgttccatttctaatatctactactttgctacttcatgtcctgtttacttcaatttgttgattacatggcttaactcaaactttcttctttctgttgttttcaatgtttaaaaaaaaagaagcacacaaaagcctaaaaacttggttgtctgccatgttgtatgtatcatcctggcacatacggaaatcattgagcaggatatgttacttcctggtacaaaagtccattcccaaagaggcaacaaaaacagtagaatctgattatctagctaaagcatatacagagtctgagaaggcagattcttttaagttatcccacaatacttctgcttcaattctattgggcagaatttagttacatggttatacctagctgcaagggaggatggaaaatgcagtctttattccaagccatcctatacccagctgttagaaaaggaaagaatgggtatgtaggataaacaagagtccctgaattaaagatgagaggtctcttatttctcagaatactgaggtatggagataatgcattttctagtaaaacatgaacctacgatttaattgtcaaaatttccccctgatttgaagctgtttctttttttctttctaaaaattaattattgtttatttagagacaggatctcactctgttgcccaggctggagtgcagtggcagccttataactcactgcagcctcaaactcctcagctcacaggatcttcccacctcagcctgaagagtagctggggctacaggcataagccaccatacctagttatttttttttttaaacaaggtcttgctatgtcgcccaagctggtcttgaacttctggcctcaagcaatcctcccacctcggcctcccaaattgctgagattacaagtatgtgcccctgccgctgactatttttttattcagtacaactctggagccacacagattacaaagcactatggacagcgcctgacactgagtaagtgttagataaaaattagctgtaaatgtcaggatctgtttgtaatgaatccatagaatcttatatctgcaaaaggatataatttaatctaatcttctcccccatcctccacctcccctacacagataatcatttatagtactggtaacctagtgggaaaaaaaggtgaattttatagaacagtgctatacgaaagcaaatagcatttaataaaatgtttacgaaataagaaaatatttttgtgggtgtgtgttttcttttaaaaatattttttattccactaaattctatttttttaggccttaaagtttctgtggcaaatagcttgtcaatatacttagttagttctgcctccaaatactgcaacattttatgtacatttttttctcatttgccgagataaaaattggtgttcatataaatgatggttcctcagctttccaaagaggaagttctatttttatatgcttatttttctaatctttaatcaatttattttaatcaggcaagttttctaacaaattgcctgtattcttcgtaataaaacaaaattacacttgccttttccagttttcaacagcagtcattgactacctttctcaaattcatgcatcagtatgtcaaaggcaattgactttcttttataaaatcaatcttatttccaagaatgtcactgaaaactgagcaagaaaacactaaaaataatctgctttctgtatatcttttaatgtgaactatagtttaagaaataccattgtgttgtagatactagtgttctattttggtagatatttcctgatggctaatattgtaaggcagacctgagaaaacctagataagattgttgatctattacttttattttattagaaagtattctgggtaatttccatagtatcaaaatgattcccagtaaaagatgaataactacatatttccattaactgaaatgtaataataaataaacactagcaaggacatttccagtgggtttttttttttttttaggaaattaaatagaaaacagcattgcagtttacttaaggacaaactgttttgagaactgaatttaaaattaggccaaaagactaatcatgtcatgaattattacacaatgggaacaaatttgcctccaaacaaccttaaaaatagttgacccaacagactgtgaataatattctttaggaaactagttactgtttagggaactctaggcaaaactaaaatctttcaagtgttcccttatccactaacaaggttcaagtgttaccagtgtttccaacatctttgtctcacagttatgaacattcaaaaatcaatgactctcaaattgtattccatctccttcatacagatcccattatcacacaagaagggccccaagatctccttccatgaaaaatccttctctcgccacaatctctacttttccaagacccttattctttccaagattacattgagaactgtgggcaagtttggcagcacaataatgtaatgccactataatcttcaaacatttatccagcatataatgctgatggagtgaaattaattatccaccagcattgtatgctgaataaatgttttaaaatcgtatactctttcaaaaaaaaaagggcactggatttaacatagcattttaacttatctggaaatgtctcaagttacagttttctcatcccctcatgggatgtagcttaaagtgtcatatacgtcatatgttagtttttgagggctgccataacaaaactaccagaaacaacagaaatttactttctcataattctggagactcaaagcccaagggtgaggggtcagtaggtttggtttcttctggtgcctctctctttggcttgcagatggctcctttctcactcgccctcacatggccatccctctgcgagtgcacgtgtctgctgtctctccctgtgtcctaattttctcttgttaataaaacacccagtcatattggagtagggcctaatgatctaatgattacattttaacgtaattacttctttaaggtcctatctccaaatagtcacatcctgaggtactgggggttaggattttccacatttgaattttggagggacacaattcagcccctaacagctggccaccacagaatattaaaattagacaagggaggaccgtgtttcaacctctgacagcttttgatcacaaaagctatcagacataactgtccaccgtggcatttcatacttcatttttggactctgaatcattttctgcacaagaaaatttgcaacaacagaagaaacaaaagccatttcatttactaattaacatatccttgctaaagtagagtcagtgtcctgagaggccaaaacaaacaaaaaacccagcaaattagtccctgctttgaattaagtgctagttctctcttgagctttcttttgtgaatcagacaaattcatggaaactgcactgacagatttaaaagtaagaaaataaatctttaaaaatcactcgttccttagaaacagcattacatcaagtgtatccattgcattttgtgctacaaataacaggagattttactaacagggatttaaacaataaggacatttattagataacaataagcccagtggcagcagatccaagttggttaattctaaaggacaatgaagatggctccagtggtttcccatttctcccctctgtcatgtcaagcattggtttctgtcatgttatggttaaaaggtggaagtcaggcatccccctctcacacaagtgcacccagaggctggaaaggaaggctttatcctctcaaatcttttgttttgttttgttttgttttgttttgttttgtttttaatatcaaggaggaaaacttcccaaagaccgccccttacatttcatggcccagttctctcctaggccacttctggtcaagagaaatgaaatttattccgttgcttttcacacacatagacaagatagacacatgctgtagagaagtgctttttaactaatttcctcaaaagggcaccgtccacttcagctggaatgcactcaatttacatttcaccagaattttcatgagagaacctgagattatcagtatcatgcttccaatgtattctggtgtttccatgccttgttccagtaatctgttgctccataaaaagtccgtcccaaacatagctgaaagcagttaatcatttatctttctcattgatcttggctgaatggactctgccaggtagctctcgcatggggtctctacgcagctgcagtcaggcagtggctggggctggggtcatcttgaaggcttcttcactcgtatgcctgacacctcatccaggctggaaagagtccaatagctgcaggctagaacagctgggtctccttgaacctgtctctttctttctaggaagcctttctacatgctgacttcagggtaggtggacttttcacatggcaactgaggctcccttaacaggtgccccatgaaacctgtcagaagctgcctgcccttgtctaacctagccttggaagtcacacagcgtcacttttgctacatttattcatcaagacagctgcaaaaccacccaggttcaagagaagggaacataaacgccacctcttgataagagaagtttcaaagaactagtggacattttaataccatcacatactccttagagattgcccccactgttaactgtttagctgaaccacctcttaattcacctgtgactccactgaacctgctttctatggccacctggacctccagtctctcatctctcagcgttctccctgtggataattttcacattcacttcacagatctccaacgatggactgtttggaggcagagatcatggtctttgtgaaaagagaccaggacttctagttaatccctatatttcagtaaagccaaaatcaaccctactaagacaaagactttcaaaaccagtgttcccaactagtaaagttataggctttattttctctcatactttttggtctccaaaggagaagtaaagcataaaaatatccaaatagcaatgtggaaggttgtcctacaccaagaaggcccaagattatctatctacaggtttgtccatcccttgaatggacatgagcagaaaatcaaaaagcaggaaggccagtgcgggaggaattttttccttggcaggacattctgagcccacctacgctcctgcccctctgaaggtgaaggattggttttatactgctttgtctacctagtaaaaacaatgaccagcttgggcaacacagaaagacttcatctcaactgggcagtggcttacgcctgtaatcccagcactttgggaggccgaggcaggcagatcacaaggacaagagttcgagcccagcctggccaacatagtgaagccctgtctctactaaaaatacaaaaaacaatagctgggcatggtggcaggtgcctgtaatcccagctacttgggaggctgaggcaaggagaatcacttgaacccaggaggcggaggttgcaacaggcgacagtgagactctgtctcaaaaaaaaaaaaaaaaaaagaaagacctcgtctctatgcaaaataaatttaaaaattaattaaatataaatagtagttccagctacttaggaggctgaagtgggaggatcacttgagcctgggaggttcgggctacagtgagccgccattgaaccactacactccaacgtgggtgacagagcaagaacctgtctcaaaacaaaagacaaaaaacagcaaacaaaacacagtgagcatctgcaatcttgtctcatttattcttgaatgtttctctgcttagtatcagttaagcagactgatcttttcttgaatgaaagattggactgagagcctggagatatgagtattcctcgagacaatttcacagagaaaaattaaagaaaaatacttagggatggcttaatcatttagaaagaaaatgaaacatattgtacacgtaatagaaggaagaaagaaaaggacttcaatgtagtttaatcaaagacatataatgcactatgtgtaaacaaatcattcaatcctgagtatctttgattcagccttaaattatgttaacattattttgtttgttcatttggtttgttttgttttaagcaggaatgttgagagaaacaggaagttgtacttttgagaatgcaaagcacaaaatttacagctactttgtttcagtacaatagacctgagaagttacacttacaagctacaaaatataagtaaaatgtatacttattctgcactttgtcatcacaaaattgagcttctgtctaattctgtgactgagtttagagttttcctctaaactttagaagtctgtcttactagctttaaggatttctatttttaatcttgatgttacaaatatttgttttggaaaccgcatagctaacatacttggtgaaaagttgaaatcgttttttctaagatcaggaacaagaggaggatacccactctcaccacctttactcaacatagtactggttacatgatcttttttttttttttttttttttgagacggagttttgctctttcgcctaggctggagtgaagtggcacgatctcagctcactgcaacctccaccccccaggttcaagtgattctcatgcctcagcagctgggattataggcgcctgccaccgcgcccagctaacttttgtatttttagtagagatggggtttcaccatgttggccaggctggtctcgaactcctgacctcaggtgatccacccacttcagcctcccaaagtgctgggattacaggcgtgagccactgcgcccggccatacatgatcttatacttagaaaaccctaaagatttcacgaaaaaagactattagaactaataaactaattcagcaaagttgcaggaaactaaatcaacgtgcaaaaatcaatcgcatttctatacactcacaatgaactatgcaaaaaagaaatcagtaaaacaaacccagttagaatagctaaaaataatagtaataaaataattcagaataaattaagccaaggaggtgaaagatctgtacactgaagactataagacattgatgaaagaagttgaaaaagacacaaagacaatggaaagatagctcatgttcatggattagaagagttagtattgtaaacatttttatacttcccaaagcaatctatagattcaatgtaatccctatcagaattccaataacattttccgcagagacagaaaagataatcctaaaattcatatggaaccacaaaagatcgctaatagccaaagcaatcttgagcaaaaagaacaaagctggaggcatcaacactacctgatttaaaaatctactacaaagctaatataatcaaaacagcatggtactagcataaaaacagccacatagaccaacaaaacagaatagaaagcccagaagtaaatccatgtatttacaatcagttgaccttcaacaaagatgccacgaacacatattgtggaaaggacaactgtatatctagctgcacaagaataaagttaaaccctcatctcataccacatacaaaaatcaactcaaaatgtatcaaaaacttaaacattaagacctgaaactacaaaactactagaagaaaacataaggggaaagttccatgacgttggtctgggcaaagattttttggatatgaccccaaaagcacaggcaacaaaaacaaaactagacaaatggaattacatcaaactaagaagcatctgcccagaaatggaaacaaacaatcaatagagtgaagagacaacccatggaatgggagaatatatttgcaagccatacatctgacaagttaatatccaaaatatgataaggaattcaaacaacttaattaaagaaaaataacacgatttaaaaatgggccaaggacacattagtgaaatatttcacttagataatttctatcctacaacagcatctgtgagaaatcctggaattttttcttaatttcagacaccacttcctccaatataatatatggtataattactttcagaatgtagtcattctattaataagggaaagcatttttacattttgaacacatttctgaaatattaacttccactttcgtgaatagcagtggacaaggccagaatttatgtttttctgtaacgtcttaaacttactagtattggtagaagtagttagatgaatttaagtcctttgattccagtcacaagaattctccttaaatacttccttgattttgtacagtattcttagtttgaacctgttaattcatccaatatttatattgatcttaaataaaatttgtatgtggctaaatattacttgtggatttcactttcattgatatttctatggtcatttcacagtgtttttaaaatgtgacctgttggatttctactttcacgaagttaatgtcattttcagcctaaaacttgtccttttaaatactttcctctggtatttgaaaatagtgtgtatgtcctgtttacatgccatgaatgctatcaatttgtttatctgattaacttgtcaaactttctaataaaattatgtaacactccggaaaaaaaatgggcaaaggacctgaataaacatttctcaaaagaagacttggctggacgcagtggctcactcctataatcccagcattctgggaggccaaagtaggtggatcacttgagcccaggagttcaagaccagcctggacaacatggtaaaatcctatccctacaaaatatacaaaaattagccaggcatggtggcatgcgcctatattcccagctactagggaggccaagatgggaggatggattgagcccaggagggagaggttgcagtaagctgagatcacgccattgcactccagcctgggcaacagagtgagagcctgtctcaaaaagaaaaaaaaaaagttcaaatcactaatcattagggaaatgcaaattaagaccacagtgagatattatctcatacctgctagaatgactattatcaaaaagatgaaaaatatctactgtaggtgagaatatggggaaaagaaaacccctacacattgtcgatgggaatgtaaattagtacagcctttatggaaaacaataggaagtttcctcaaaaaattaaaaatagaactactctctgatccagcaatcccactattgagtatatatccagaggaaacatagtcattcagccaaagagatacctacatgtgcattgcagcattattcacaattgccaaggtatggaatcaacctaagcattcatcaaatgcttattcaacaaatgaataaacaaagaaaatgtggtatgtacacataacggaatactaatcagcttttgaaaagaaggaaattctgtcatttgcgacaacatgggtgaacctggaggacattgtgttaagtgaaataagacaggcacagaaagaaaaataccacatgatctcacttttatgtggagtgttaaaaattcaaactcataggaatagagagcaaaatggtggttaacaaaagctggggtttaggagagtaggtcgatattggtcaaaggacacaaaatttcagttagacagtaataagttcaagatatctattgtacatcatcgtgactatagttaataatacattgtatacttgaaaattacaaagagagcagattctaagtgttctcacttaagaccagcttaaaaataagtacatgaggcaacacatgttaaatagttttatttacccctcccataaggtatataaatataccttatggtataccttgtggtataaatttatatatatatatttataaatatataaataaatatttatatatacataaatatatatatatatatatatatatatatatatatatacacacacacaccttgtgggagttacataataaaacatcatgttgtacaccataaatagatgcagtttttacttgtcaatttaaaaatattcaaaattgcattattataaaaatattttaaaacattaagaactcagcatgtattcagaggatgctcataaaatattcatttcttcaacagatattatgtagtagactaaagaattataagacagcccttatacttcaaagaacttaaaattgaatgggagaaataatgaatgtaaagcatgcttactattacttgtatgtgtaagcagtgttatcggagttcagagaggcaaatgacttctgactggcaagatcttgatattttcaatttagatttactgaaatattatgtaattccacggtaacagaaggaatgtgaagtttcttttcctccctatccaatacttccctctagtggcgccatggctccttaacaatacagccctactccccagcgggtaagagaaagggtggtgggaactttcactccatcaacaaatcactgtcaaatctgaattgatctgtgaacattagttttgagttgagccatttcaaatgaaacccttgtttctcttagagagaactggtgtccccagccagaaaaagtgtcctaccataaaagtatcatgttacagggcccagccttttagcataagatgcactgggaaaaagcagtaatccctgagaaacaagatatcaaaagaaaaaatagacctcccataactttcatgaaaaagtcaatttccctgctcccagtcaaaagctgaggctctagaatcccgtgaaatgctgtcaatgcgacaggcaattacgtcttcgaatacttttgttccactaacaaaagaaaaatgtggattgttttctaagtatgggttgagacactgtgtgcctaaaaatgctttcttctttctgtgacacatgcgagttttattagagaggtgctaataaaagcccaaagctgaaacagtcatctttaccggaaactttgcaatacagttgtctttcagtatctgcaggggattggttccaggaccctcagggataccaaaatctgcagatgctcaagtcctgcagttggccctgtggaacccacagctacgaaaagcaggccgtcatatccttgagttcttcattcctcaaaaactgcattttaaaacagggattgtttgaatccgtggatgctgaacttgcagacagggagaactggctgtactgtggcctccagaattgctgcttcagggcctctctgaggaagcatggctcagtatgtaactccctaaaagcagagacattttctgtcttcttcatgggtgtacattccagggcctagaaccttgccaggttcagagtagacttttcaatatttcctgaatgaatacatgaaggaaaactgcacatttctccatacaaaccagctctgccccaggacacaaggaagggtagctttgggagcatgtgaagacagagctttgggcacagcagcacctggatgggttgacttcttctcctggagtggacaagaaggggtgggcggggatatggaaaatcatgttcctgggcatgtgaggtgtcaatgactcaaaaaaaattaacttcaaagggtagcaatgttcctgaatggacaggtgggggctcagaataatggttatttgggaactagtgtagatgtaacctcagctgactcccaagctggcatggcttcagcataacacagcattaacagcctcacgtctcctgaacagtgctttttcagttctaccattcttatattcttacattcaagtgtcttggaggttgtgttcctttataaggaaaatgctgcaactgtaaattataactgaaatccctagatcatctccactgtctgctttcctgttttcctctggttatagaaggtagaaatctaagaataatgtagcctatcctttttacaaatttacccattttcctattaactttctattgattttgctttctttgtggcagttattctgcgtctcacacaaaacataacttataagatattaggttactgttaatatcgttactagcacctcctgccacccttactttcatccaagctgacaactcactttgctcaatagtctgaaatcttgcttagtttattataatagcctcctcattatccattttatctccactctggtccatcttatatattactgcctaaatcttctgaatttctataatcatattttctcctacccccaatagtgccccatcaaaaaatcaagaaatgggctgggcacggtgactcatgcctgtaatttcagcattttgggaggccaaggcgggtggattgcttgaggtcaggagttcgagaccagcctggccaacatggtgaaacccccatctctactaaaaatacaaaaattagccaggtgtggcggcacgtgcctgtagtctcagctacttggcaggctgagacagaattgcttgaacttgggagacaaaggttgacatgagtcgagatcatgccactgtactccaacctgtactatagaacaagactctgtctcaagaaaagtaaaaataaataaaaaataaaaagaggtttcatctgtaagaaaatcttcagagcattagctccttaaatagaagccaccgattggcaggaagtgagccctaaaacaaactgccaacaatgttacccttcatttggtagatcccaggcagtcagagcccttccttgaaatttttgaacttggaatcaaaaacagcctttattttctgtcaggtgtgtcccactgaatttcacatgttgaatccctaactcccaatgcaaccatatttggagataggacctatagggaggtaataaaggttaaatgaggtcataagcgtgggggcccaatctgatagtattggtgtccttacaaagagagaaagataccccacaacttgttcactctccacacatcacaaggaaaggccatgtgagaaggctaccctatctgcaagccaggaagggagccctcattaggaaccaaatgagccggcaccttgatctgggactcctacggctccagaactgtgagaaactaaatttctattgttgaagccatctggtctgtggtatactgttacagcagcccaaaccatctaatatcagtggtgaagctgggaagcatgtcatcagaggatacatttctgccatgctcaacaagggaatttcaaaggatgaaccatgacaagagatggagagagtcctaaaaatactcctgtgctccagttgtttatacataggacaaagagcagaacactatcgaagtattcttctttcttttgtacctactatatgtatgaatgagatttataatcagaaagttttttaaataataataaacgcatggtgttctttattaagtgttctatataactccacttctttttctcggcctactttataatcatctaaaacaaaaaaagaatttctaccaactaaaaggcttgatttggaaaccagttatcaaaaatgtatgatttaagctaggctgctacagctttgggaaatcaacatagggaatctttcaagacttgagaaataaactcatgttcaaaattacttcttgagaaatgcatctttttgttttgttttgtttgcttttgtctttcaattctgtaaagggattctgtctgtttcgtccagacatttttttgataaatatggacagaggtaaacaaaaaagagactccaggctcctcatccttgactgagacttcctggtctgttcctttgttgtatggtccaactaaagtggaaagaaaactttttttgaaatcattttaatgatcattagcatagaattaagatggggaaacgatcaactgtaaagatatgtttttgtgaccaaaacagtcaagatggttcactgcatactgatttcccaaagcaggtactattttaggaaaaagcactgtagggagagtatccaaatgttaatggccataggctgttctagttataactgcattaactggggtaaaatggcctggaaagagaaaaaacaaggccaaacaaggataccagcttttagccaccagactaatgctagagaatatttttagcagctccccagagggaagatgatggcctcctccaagaggtcaataaagatctggcataatctcagaattcaagaaacagcccatcttacattgtactaatgcaacattgataattagaaatcaacactcaaatccaaatttacatacatacatgcatatattctggcactaagtctgcaatatctaatgttacgaatttcccttcctttaactgacttcatgtatgccttaaaattaccatttctttctttttttgagagagagagagtctcattatgttgcccaggctggattccaactgctgggctcaagccatcctcccttctcagcttccaagtagctgggattacaggcacgtgccaccgtgcctggcttacaattaccatttcagtaggcaattttctagtttccaagcaatgtaattgtaaacatttaatccttttttccctccagtatattatactgagataaaaatttagaaaatgtcttgggtttttattggttttcctcattaatgagtccttcaaaatatccttgacttgtagaagctggttttttgtgtttttttcagatagtaaatagcagctgtaaaactataatttcaatagaaataggcaactggaatagatacacagtcagactcacaggagtctgaaagaagagcgaaatgaaaaaattgccaattcttatgatgctaattcatcaaacataaccacgaatacaacaatattcaaaaggaataaagtttgtggggaaagcaaccagtaaaattatcctaagtacttttttccttttttctgcatttaggaataacatggtacataacacataaacaaagggcttcagaataagacatatctaggtttgagttctagttcaaatgtaattattgtgtatttgatctctgtatgttctcagcttccagttcttactaatgatagtaacaataactgcctgagatagattgtctacattaatttatatttgggattcttgctaaatcaatattatagttatcagatcgtgttgcagattatgaaaccagaaaacaaatctatctagaccctgtgtgtagtggtataaccatttgttgtgctagtcactgtggaagagagaacaacagctgctttctcctactccctatactctacaacacttgtcctctttctgcaattcatccctgcaaagcaatttccttttcccattccttggaatgcttttcttctcactgttagctggctcctttttttctggtctcagttcaaatgtaactttactcagcccttttctagcttccactgcgctattcctcctaatagatcaccctgttgatctgcagttcccactataggacagtatcaggcttatgaattatttgttgtctatctccaccaactggaatgtaagacccatgaaagggcttgctcatctatttcacagctgtattctctgagcctacaacagtgctttatacaaagtagactcatactcagtaagaaattgtgggatgggtggatgaggaagggtaaggtttaagtgaatgataaagatcctcctctgctcataatctgaacactttccatcgttttcatggctaacagctgctcttagtcttcatcacctctcatctaggttgctgcagtaagcatcttaaaggatctgcctgtttctaccgctgcccctctatggtctattttatcacaacaatcaggctagtcctctaaaacatgtaagtcattcttcattgagaaatcctatgatggctctccatgtcactcaaaagccagtccttaaaataacctacaaggccctaattgatgtggcccaccccctactaacttcctctccatcacccactgagtggtatctactcttgcctttctgttctttgaacatgccaggcaccttaggacatttgctctaggctgtttccttttcctagagtgccttttgcccatatacagttagccctccatatctgtgggttccgcatctgtggattcaaccaacagcttgaaaacatttagtaaaaaataaatggctgcatctgtattgaacacatacagactttcttattggtccttatccccaaaacaatacagtatatttacacagcatttatcctgcactaggcattataaccaacctagagattatttaaagtatataggaggatgtgcataggttacatgcaaacactacaccattttatataaaaggcttgggcattcacagatttccgtatctgtgggaggtcccagaaccaatttctaacacagtgggatgactgtttctgaccagttcactttcggatgtctcgaaataatctgaccttcctgttgaagcctaccctaactttaatactgcaaccaaccaaccacacccatgtgagttctcccctttggtctttttccatagaacttatcttttaacctactgtgcaatttatttttaaactctctttcctaccacccctttctataacatatgaggggaagaatctgcttttgttcaccagtgattcctaggtacctaaaaccagttaggacacagtaggcactcagtatctcttgacgaattaccaatctcgatatatatagaaggaaagtcctgaagtggttcacaagatgctactctccacatggatgcacaacaggacccaggaaaagggagtcccaaacttgaagtctatgaaatttccagcttcatgcatagttctctcaaagcaggaagggttctgcaaaccctgaagcaaactacctagagcagcatcgtaattctttttgattcttactctctgtatctatttggattttgtgttccctaaatagacctttttgaaacattcctattatgagcagcctattatggctaccatttattaagcacctaactactgtttaggttaaacagttgtgggtccattagatgatagctggggagcccaggaactgtcctgctttggttggttcctgatgagagaaacctacctgaacccactcggagtgtagaaaaaaacaaatactgaaatatcttacaaagccattctactaaagcctaattctaagctgtgggatatatccaatatttaagcatactctcacatagctgagaaaaaaaaaaaaaaaaagaaatatagaccccaggagccaaagataatctgcttccactacccccgggttctagcatattccaagatatactggagtgggtagggggaaaaagcaatatgcattcaaacggcaagttgagacagaagttgagactaattttgagctgttagaagtaaaatttcactaaaataacatcacaataatgttgctttcacaagtttagtggcaaaagaatcatttctttgatccttacctaagatttacaaggctgaccaaaagttgaaattattggcataaagtgataaaatcagacaaagcatggtaaagactgctttattggtggcagttactacaagtcaataaatattgatccccaaagaagagctcggttatttatcagattactggtccatagagagctgaatgaaactgaaccaagcgattgctgggatgactgaagtcactcctgcttcttgggaaatgaagccacagccagctcatatatggcatatgctgttcctaaaaataaaaaacaaaaaagaacttaaccataaattctaagatctaagtgtataaatttaatattccagttcaaaagttgtaagtttgcattaagactaccttaattggaacacaaaaaagtattttgataggtgctggaaaaattttaaataaatatatgtaaaatatatttaatctagttttaatatagaaagtgtggcacaataatatatttgtcaacataaaatgcaaaaatttttaaaaataagattaagaacgtatacaaaggttatttccatattaacccaagactgcctgagaaatgctaaggatgattaaatgccaaagaaaaaaagagttcaaaatatgcaagccttccctaaagtgaatgtaaaaaaaaagagtgatataattttaaagtaatcaaatgtaatataaaaaatagctgataactgggccgggcatagttgctgaaacctgtaatcccagcactttgggaggccgaggcgggcggatcacctgaggtcaggagttcgagaccagcctcaacatggagaaaccctgtctctactaaaaatacaaaattagccaggcgtggtggtgcatgcctgtaatcccagctacttgggaggctgaggcaggagaattgcttgaacctgggaggcagaggttgcagtaagccgagatcgcgccattgcactccagcctgggcaacaagagcgaaactccatctcaaaaaaaaaaaaaaaaaaaaaaaagctgataactggaatttcattttaaaaactacttaccagaatgtctaagaaatgtcacattggccaaaaggaatttagggctttatctttttttttcttttttttgagatggagtctccctctgtcgcccaggctggagtgcagtgacacaatctgagctcactgcaacctccgcctaccagttcaagcaatcttcctgcctcagcttcacgagtagctgggattgcaagtgtgtgccatcacacccgactcatttttgtgtttttagtacagacagggtttcaccatgtgtgccaggctagtcttgaactcctgacctcaggtgatctgccagcctcagcctcccaaagtgctgggattacaggcatgagccaccatgcccagcctataccttttataataaactggtaaatgtgtttccccaacgaggagattgtgggaaccccaacttaaagccagtcagtcagaagttccgaagacccaaacttgcaactggtgggaaggaggggacagtcttgtgccatcaacctgtggaatctgatgctatctcccagtagatagtgtggaaactgaactggaggacacctagctggtgtccattacttggtgtgcagggaaaaacccccacacatttggcaacagagatcttccatgttgattgttgtggtgtgagagtagagtttcccaaacaggtaattaatatgatttcttcatctttaaaatgaggacatattatagacttcatgcaagactcacagaaatccaagtatgtggcattcctatgaatatgataggcataaaataatcactcaaatatagcatcccttctctttaccttccagtggaagtattgttctgtacaaattttgttttggtcataaatatgtctgtacaaagtttagatgtaaagtgtgcttttattttgcatcacagtcaaaatgttttaaagcccttgctgtaagaggtgggatataatggatgtttttgactgaaatatagccttcactgccatcaatgggactcagaaagccaactctatcacaacataatcatcaaatcttactggtgttatttttttattaagacatcaaggccaggcgcagtggctcatgcctgtaatcccaatactttgggaggctgtggcgggcagatcacctgaggtcaggagttcaagaccagcctgaccaacacggagaaactccgtctctactaaaactacaaaattagccaggcatggtggtgcacgcctgtaatcccagctactcgggaggctgaggcaggagaatcgcttgaacccgggaggcagaggttgcagtgagccgagatcgcgccattgcaatccagcctgggcaacaggagcaaaactccatttcaaaaaaaaaagaagacatcacaatgctcttatacagtatgtatcagtcaccctcttgaatcattatgagatatagtaagatatcaaattctggagacaaactgcctgcattaaaatactggcatagcaaaagcaataaagttatcagttatcattactattacttttctataaaccttcaaacattccaaaggccttaccaccaactgtaagaatcatggtggctctatacaggagggcatcagctaccccaccctttagatacagtggaatttcatcatcctcctagatttaaaaaaaaaaaaaaaagacaataataaatgtctcactcatttccaactaagtttcaaaagaacaggcatataaaatgatatagctccttaaatccctagaattaaagtattttaagtattaaaatttaaaagacctacaattttctttattccgtctctactactactacttttaaaataagaattcctaaaagtcagcattcttctttcaccgttaatttgagatccattaatgacggtctttccaaagaatatataaacattaaagctataaaacatacacactgatctcaacaactttaatataacttaaatataaaagaaccaataattgccacacattagatttagtcataggaaactttttttcccttaaaaaagtggggaagggattttggtttataaccctaaattatatccctagcatctaatccagcatacagtagctatttagtacatctgttcaataaagtattgtatttttaggtatatatgatacaactatttttaatcactttaagctttatttaggaaaagctagaaaccataataaaacaaaaatcactcataatcaaactacttataaaggtaaattgctctgctccaccaggtctttccccaagagacaaccactattagcactatggtacatgtccttgactttttttgtaatgtttatattgtcatatgatctaatttatacacatacttgtttatcccaactcttaccttttggtaatctaataattacaagtaacatctcctataaaatacttcagtacctggaacagtttttgcttctccggaactttatttttaaaatgcctgcgggaagcagtgcttatcgtcctctgcccaatctgacgaagagcctaaaatgaaaatattattaaatagacttagagcctaaagaaaccttcaaaaccaactattttcagtcgttcatattatagaaaaggtaaattgagacttgaagcatatctgatttgtcagcagcaaagtcatgcaagagcatccaggtttttcaatttgttatccatcctctgctcttcgaattacattctgcagtctccaaataacatattcaagaagcaattcatatagattctaaccaaaaaataaaatcatgatctctacctgaacagaaccagtagcattttataatccttgatgcaaacatattgacatacacatattacaaaaatagtgcttaaccaaaatacaccaaacccaaatattttcataatatactgccatatcatcaaaaacctgccaggcgcggtggctcacacctgtaatcccagcactttgggaggccggggaggggggcggatcacctgaagtcaggagttcgagaccactctgaccaacattagaaaccccatctctactaaaaatacaaaattagccaggcgtggtggcacttgcctgtaatcccagatacttgggaggctgaggcaggagaatagcttgaacctgggaggcggaggttgcagtgagctgagatcgcgccattgcactccagcctgggcaacaagtgtgaaactccgtttcaaagaaaaaattctattactaggcaggcagatcacttgaagtccggagttcgagaacagcctgaacaacatggagaaaccctgtctctactaaaaatacaaaattaaccaggcatggtggtgcatgcctgtaatcccagctaatcgggaggctaaggcaggagaatcgcttgaacccgggaggcagaggttgtggtgagccaagatcgccccattgcactacagactgggcaaaaagagtgaaactccatctcaaaaaaaaaaaatctgttacttggccaggcgcggtggctcacgcctgtaatcccagtactttgggaggccaaggtgggtggatcacctgaggtaaggagttcaagacccggcctagccaacatggcgaaaccccgtctctactagaaacacaaaaattagctgggcatggtggtgcgcacctgaaattctagctactcaggaggctgaggcgggagaatcgcttgaatccaggaggcggggtttgcagtgagccgagattgcaccactgcactccagcctgggcgacaagaatgaaactccgctcaaaaaataaaaataaaaaataaaaaaataaaaaaggccgtgcacagtggcttatgccagtaatcccagcgctttgggaggctgaggcgggcggatcacttgaggtcgagtccgagaccagcctggccaacatggtgaaaccccgtctctattaataatacaaaaattagtagggcttggtggcgagcgcctgtaatcccagctagttggaaggctgaggcagcagaatcgcttgaacctggagacggaaattgcagtgagccgagatcgtgccactgcactccagcctgggcaacagagtgagactacgtctcaaaaaaaaaaataaaataaaataaaataaaataaaataaataaaaacaacaacaacaaaaaaaaccctattacttgacagcaaatagactggcatgattccttctcaattaaaatgcttctctcattacatttttcctaaaaaattttaaagagggtatacatcttttaaagaagagacatgcactacatatccagttgaattaaataatgaaacaaatatgctctcgattttctaaaattacattgaggattttaatgaagcaaaacttcattaaataatttaaaaaataaaataatcattgtcgcatttttctttatcaaaatttggggaaatatttcacatgctcaaagtcgatggaggggtgaaggacaatgcacaatcgcctgacggaaataacactgcacttcagccatgactattcctaaagttccacccaaaattgaatggcttggtttttaaactgccttctcaagctcgcaaagctcaaaaccattgaaacttaaaacctttcagtaccagaaaaacacctttctgcttgatgcttccgggtgtcagacactccccacctgggtcttggttttactcagatcggagctactaacctcatcaatgaccgacagggttagaggtggtgactaagaacccaagacgggtctaacccacgagtctctggtcacttccccagcctctccactccttacatctacccagtaacggcctggggcgagaggaatagacggaagggaaagtaaggtcagggaaaaaggacacgaatcaaggtgacttcattagccgccttcggcacccctcccaggtgagggttttctgtcgtggtgcctcagcctcctctccactccctcgcccccatcatgaatgcaagatgagaagctcctcaccagcagattccgcagcatcttggctgttactgaccagcaaccgccacaactgaacaccaccaacgaaaatggccacgccggaaccggaactacctccgagtcttgcgtatgcattcacgaacttaaatctttccgggccgaagagaggcttgcgctcctaaccatagagagcaaaagaaaaactagagcggcagtacggctctatccgctctagccggctcgccgtctcagtcccgtgatctcgttcctgaccttttcgatgttcagtaggctggtccctggagctaaggctggggaaaaagcaaacgatttatgagacgaatgtaataagcttagatgaagtcaatgtgagaccaggctatcaaagaaaactagtgtctgttttgagcgagaaggcgtaaaactgggcaaccttgaagccgctagaaactgaacaaagactgggttggccgaaatacagctctgaagcctcataaaattcaaaaaagaattactcctcttacgcggatacagtcagttttttccaccgaaggaattgctgcggcacattactgttccttgtgttgagaatatgctgtaagagctgtgtcgagataccagtttttatattcttgtaccttcgactgctgcagaactccccaagcaagaagttcttccacagtgtccccaaattgtggaagaggctcgctcgcttctgaggaaacgttagggaacaagaaatgggatggcgaatctggactcaaaagtcttgctgtcccagatccagcagggcactacattcattactggagtagagaagcacagcaattatttgttgtacagaaaggctgtcggtgtcatccattttgcttaagtaatccccattacaagtgtttatttcttgtacttaccctcaagtatgtacaaatgcaaatatctaccctgtattacaataatctttccactttctacaaactcttacaaattatttgattgccatttcaaataagaaacccatagtttcagcaaaggataaaaattagtaatattaaaactattccttataatccttggggttttcttcttcacaatctactgtatgtcaatgggcccaccaagttaccagtcccagttaaaattctcttcctcaccaaggtttataaacaccccaattcatgtcttccttagattggtactgaaaggacctggttttctacacccctctggattatgcatataaccaaaactctgggcaaaattaccacgtgccaatagctagggcgtgggggttttttaagtacattgtccataatctgaatttgttagttgtatgtgctctcttatgttttctccacttagccaactctagattgtaaatttcccaagcgcagagatgatgtggatttcttaccaatcccctagcactgctaaagacagtattaaccaatacatcaattaattacattgggtgacagatctaagaagcttatgaccctgtccaaaaagagccatgaggccaggcgcagtggctcacgcctgtaatcccagtactttgggaggccgaggcgggcggatcatgaggtcaggagatccagaccatcttggctaaagccgtgaaaccctgtctctactaaaaatacaaaaaataaggcgggcgtggtggcgggcgcctgtagtcccagctactcaggaggttgaggcaggagaatggcgtgaacccagaaggtggagcttgcagtgagccaagatcgctccactgcactccagcctgggcgacagagtgagacttcatatcaaaaaaaaaaaaaaagccatgaattcacattaaatagatcctaaagtagacatagattcttgtatgcatgttattcagtacaatttccccctttactggatcattccatctattaacacattcccaaattaaaaacaaacgaacaaactcctttgattaccgttaccatcctatagatttctttatacttgtctctccttctcctcctcctaatctttttttgatcccattttgggcaggcttttactgctcttgtttagaatcaccaatagcttccaggttgctaaataaactgtcaatctcaattttcaccttctccatctattagcagcatttaacatagttaatccgtccctcaccatatacttttactttttaatttggaggtaaaccatacatgtaagaaagaatatgatagtttgaagcatggtcttaaagtggcttccatagtactccttcggtggttctcctattttagtggctgctccttttactttcctttcctggatccttatcctcttaaacctctaaaatttcagtttctcaccttttttctacattcatccattttgtgatttcatctaacattgaactactactcccacttcctgtagattgtatgaagaaagaattgttttaggaaagaaaaactattcatgtgctgacaactctcacttatctctcgcctggcctttcccattaacttgagacatctccacctagatggctaatgcgcatctcaaacttacaaacaaaactgaattctactttccactccttattccccaactttctcctctgcaattttccttatttcaagccttaaactttgttttctatcatactctataaaccaatttattaaaaatttctattggctgcaccttcaaaatataatctgaattgaaccacttctcattatctccaacagtactactactgttggccaagccatcatcatctcttgttcagattatgtcaaaagcctttttaacgggtttccctgtttccactcttccactatcttccacacagcaatgattcttttaagaacttaagctggatcatatgactctgctctaaactcggttgtgtttactcatgtatccctggcatctagaatagtaattggcacatagaaaatgctcaatatacattggttaaatgaatgaactgtatcctgcacaaaagaatggactattgagtataaaaattcaaaacatctgtcttagtacttgtgctccctccaaatgttttcagtcccagggttcctcattcattatcttcttgctccttttctgtaagttgtgattatcctgacatacaaatgactgaaatttgcctgcgtacctaacaaactttattgcatcttcccaggcacaccagaaacattaccacattttaaaattcatcctctgaaccagaagttactttcaaagtagaatgctttccaaaacatcagtttggggttcttttatccttgctcttttgtaatgttagaaaattagaaaatggttctttcggaaaatacttactccggagggttttgtaacagtataacaaaattggcagggggaatatgtgggaaatatctgggaaacctgaggtaggtaatggtttaagtctcgtcagtaagatggacatcagatgcgaaagtactaagtgaaaatatctcataattactgatgcaaagttaccagaggacagttacccaatcttttttttcctttttttccttgtctgctttttagcagacaagataaccctgactttgatcctgcctatagaatcgataagtaacaaaaacagagggaagccagaatagttttgtgtgatttggttgtgtgtgtgtgcgtacacacatctgttaattctagagccatgcttaaccaacttccaattttataaaaatatagaacagtttcatgtgaactttaatgttacaaactactggttaggtaaaagataacatttcaatataattccatactttatcatattctgagtcacttttggacatcaggaaacagttgctatcttagttgctgtattagtttattattaaatactttaattgcaagcctcagtcttttcatcattaaactttagttagactaactcctaatgatctttttctctgactctaaagtccttatgataaacaatttcataaaacatatgaatgaggactaatctctgatttttttttttatcttgcccaaattcatatctaaagggtctggggagtcctgccctacaaaccacaaattctcatcagatgggttttatttaaccctgtatattatgacttactttcccatgtgactctggcataaggaggaagaaaatcaaaatgttttaccccaaaacatgtctctctgccatatcttgaaattgccctacaaagtttcttgtgggaaaaatccgcattctatagagaatctcctttcccctttccagatccaggagataatcaactaagagccaggcactcttttaagtctgataagacacattttataacctgctctctctgcagtccgctgagagtttcctccgcacaataaaacttagtctccacatcctttatctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcccacatcctttatcttaacctaaacatttcttttctattgatcccagatcttcagataaactcaatcagttgtcaaccagaaaatgtttaaatttacctatagcctggaagtcccccgctttgagttgtcccgcctttctgaaccaaaccaatgtatttcttaaatgtatttgattgatgtctcatgcctcccaaaaatatataaaaccaagctgtatcccaaccaccttgggcacatgttcccaggatctcctgagggctgtgtcactcatatttggctcagaataaatctcttaaaatattttatagagtttgactcttttcatcaacatgaacatgagtcattccccattgaacaataattaccggttacctactatgaatgtaacactttgtaatacacgcaagggaatattgttttaaagtctctgaccttctggagaatataatctaattaggaatatcatacataacagtaaatttgatgcagacataaatgactctccagatgactggtacaacaaaagttgtatgggaaattcaaagaaactagtgggctaaggttgtaaaaagacagaattttgggccgggcacggattatagcctcacccctgtaatcccagcactttgggaggccgaggcgggcagatcacgaggtcaagagatcgagaccatcctggccaacatggtgaaaccccatctctactaaaaatacaaaaattagcctgtagtcccagctactcgggaggctgaggcaggaggatcgcttgaacctgggaggcggaggttgcagtgagccaagatcacgccactgcactctggcctggtgacagagtgagactccgtctcaaaaaacaaaagacaattttggcaaggtctggtagaataaatggagcagaaattaagtcattccagatgtaggacaagaacatgattaacaatctgaatttggaatcaagcgttgatgtgctgcagaactgcaaaaacagaggcctagatggagtgaaaagagaaaaaaaatatattgttgttaagaacttggaagtcagacagatcctgaatctgccatttagtggtagtgacatgactgaacgtaagatacataatctatttatacctcagtttctcttgtctttaaaatggagataacagtattcatcatcattgggtggctgttaaaataactcaataaatatttactattatgggaagaaaggttgggtaagaagaaaaatctaggcaaaagctataacatttgcaaaggcaaagaagacagggtggccaaatgtcttggggaattgcaaatggtttgatttgcagaacaaatgaagaatgaggtaacagtggaaggctgatttcagtgatgaattaaacaacttgaagggctacttagaggttcaagtagcaaactgttaaaatcggagccctatttcaagatcgttctagtaataaaaggctggattgggcatgagttattagggtcagagagtctgtcagaaagctctcatagtaatccaaggaggaagaaaaacctaaactaaatcatcaagagagatgtagataaggggagggatgagagacccaactaaaaggaagaacattcaaaaatcaacacaatacagtgattaggttgggcagctggagaagagagctagggtttctggcttacctcaaggtggttggctataccattcacagtaatgaggaatgtaagaaatctcaggttggtgtgagattattcctgttttgaccttattaaacccaggcttgtgtggaatgattgctgcttgggccttactaacttaggttaattcattattaaccttcatttctcaagagattaataatgaaaaatctagagctcaagacagatgtcaaggcacaagaaaagatagagaagtcagtcagtgttaagacaatggaataataaggtacttaagattgttcaggcagaatgtgtaacttaaaggcacagaacataatctcaaagaactcccaacattaaggaatatacaaaggagactaaggaacagataaggggaaaaaaatcaggagtcattcacagaagccacatgctaaagatgaagtgggaaggaaaatgcctatcaaatggagcaaaaagatcaatataagggtgagttcacttgatctgacagaaaagaatgggaattgttcattgaatatctatttttctatgctttgtgctaaatgctttttaactgtcactttccttattgctcaaaacaaaatctgtcaaatgggtattgaaatccctattttacagacaaggaaaggtaaatggcttagaagatttaagcaattgcaaggtacagcttgtaagtataggagccgtatcagcctactcctgaaacccatactctttctactgaatctttcagacacaggtgacagtcaacagagtacaaacgatgtaatcttgaggtgaaaacctgaccctgactgaagctgaagatgataagaaaatataaaggacatactgtttcacaaaatttgttgtgaaaaggaaagacaacatgccctggggttattttacaccactgatacagcaatttgacaaaaatttataaagctattgtctgcaattctgtgcttgaaacaaagtgacataacaagcttgaaagggatgtaaggggagttcaatctttttccacattaccctggatagaaaagcttgtgatatacaaacagacaagctcctattaataccacttaaagtacataacaagtttatcttttaagatttttttaaaaacattataaaatcaccaaaaggtgaagggtatatttgcttcaaggtgtttctgatttaagatagtggattggccccatgagtttgtctctcctccatcccactatagtaaaatgaaagaaatttttaaaatatgagaaaaattattgataagactcatcatcttagatgaatctcaggggcattatgctaaagaaaagaaggcgtttcaaaagttacatatggcatttattctatttagaactttctagaagataaaactatggggatagaaaacaaattgtggattatgagtggggggaagggagaatgactacaaagggatagtataaggagttatttggggagtgatggtacttttctttatctctggtgttaaaactcacaaaactatgctaccagaacagaagtaaaatttaccatatgataatctgaaaaacaattttaaaaaagatatgagcccaaaatttgaatagagaggaggcagcaacagacaaatgatttcaacaaatttgtggaaaactgaaagcagatggaatatgactgagctgaacagagaaagctgcaatctagagggactacaaggcggataccagagggaagcatgctgattgattccacaacccctgagaagctcagatttggaggtgaaagttacagcaaagagtggaggcagggacaggcctgaaaatgactagttgaaagcatatacaacagaatggcctgatccccaaagtcctctgccctaccccttagccataaaaatatgatctctcacttccatcactgtctctcacaggtagaacaccagagaatttttatctggagaaataaatgggagacaattaagtggaagaaatatggggagggacagatacaaggaagtatgtgtgaagtggaaatcaggaggtgagatggaggacaaggaagaagcacagttaaaagcagtaagtaagagaacctccctagaccccttgaagcactgcccacaaacacagagctttcaaatagtgttttggagtctactcatatattgccaagactagccagaaataacaggaaattcgcctatatgaacaagagaaaaaacaaattacaaatagcaacaaataaactttggtgttaatagagcagtaaacaaaagtagtaatatatattcatatatatatatcctcagaaaaataagatatctataaactaagtaggatattttggaaacaaaataaaatgaaagaagttctagaaattagaatatttttagaaatgtgctacaaattcaatacaaggaagataatgttgcaagaaagttatgtaaatgttttaaataaggcaattattaattccaggaaaaataaaattatgcaaaagaaaatcatattacatttgccctagggtataaaatatttatacagtcatacttaaataacagctaatgcatttactaaatattatgatataactacataatagaaggcaaagtatgtgtgttagagagctaaatcatgtaacatcatgtaacaataatgtctaaaattgttatatcaagcaacagaatagccatactatttagatacactaaggtaaaagaagaaacaacttttggagtcacagtgattgcctctgggagggaaggaaagttcaggcagggactactattttttatcataaagcctttagaacttactattttattttttaaaactgtgtacatgttactttgataaattttatagatatacaaaaggaaataaggccaccacggtctgatttgtttttagacaagatatttattttgaagttccaaatgacattagcagaattgtgatttttatgtttactgaatggtgcatgggataaaaaggggttctaaaacactttactagatcatccaaaccctacaatagacacttatgcatcaaaattcttgtaaaaggaccacttccctactccctccaccctcccctcaaaatacccatgttcacaaagaacaaaaccttacagcttaaccaacaaaaaatgtgtcatacaataattctaaggcaatggttctatgaagacaggagaggtagcaggctgaaccgcattcactgaccctatctctcagctgctcctcctcactagtcaggtttttcctgtgtaccccacttcattatttccatcatgcttacctctctgtttactggacattccccttgatctaataccaaacttagccagtctaactgtaactcagatgataatctgaccacttcctggtaagaacaaatggttaatgttgtcacagtgattaataaatacaaatatgaattaatttaacaatgaattacattttatcccatccaggcatgaagaagttaaaacctggactcactgacgctgtgttaaaatttagtgctaaatgtaagcaacaacactggagcattgttattttatcaagacacctgaacatagcaaaattaattttgttcatttttattaacataggacatactaaccaaatattatcatttaataaaatcaacgttacaaagaaactcactagcaaataaacaaacgatattcacttgactcttctcttggttgaatgattttctattaattagtagtacacagctatttttatcaatttatgcttaaactgccttatgatttcaatgaaatttcttagcttttacttgttgaataattttttcaattgggaatcttttcataattcaaaatagttcctgaaaattaatgcatccttcaatgtcttctacttaagctgggtgcatttaaaatgcaacacaattctttgaaaggagactatgacatttgagcataaagcctataagaaaaagaaatgtcttccctccccccatgcttcacagagactatacgaatgttccatactcttcatatttagcaacaggagttccttagagatcaaacagcagaaaacaggaggaacttaggccatcaatggacttgtaaaacagataaaactccaaatgtattttaagattccatcttctccacagatgagaaagtgctgaaagggctcttcaacttttctttagcgacatcctctgtgccccagttagaaaaagagttgcaggatggtagtcctccttaaacagcacagactcaatctggaaagagtggcagaaacccctctcccccaacaatgtatccccgaaaataaactgccaagtgcaagagggacaatcttcagaataaataatattctgaaggactgacaaaacagactatttttagacaaagaacacaccaaatactccgaaatttcaggataaccatacatcaagtacttcgtgcaagtaatatttttaccagttaaaagtcattatgaaacacacattcttttaactgaatttcatatgttatataaaacttgaaaagtgtggcacatttctactattaaccattacattgttttttgttttttaaaaaaagtatatattaatcaaaagtatacattacccagaccttttgatttaaaatataactgaaggaaaatataaactctgagtaaacaggcattcttctacacaaacatgagttatttcagtaaaaaaacaacaacaaaaaagcaatttcaatgtaattaagccacctctgattaatacatattttcatgcatgtggaaaaattatttttaactagaactttaagaataagttccatagcaaacaagttacagcatttattcaataaggaatattaaaataattcattagtaaaaaataaaataacttcaaccatatacatattataatttatcatgtacatactccaaaatccccataatttaattaggaaatttatagaacatctttttaaagtatgtcttaggaaaaccaaccaaaacaattggtgccttaactaaagagaatgtgcatacacattgctatttgacctatatgcaaaagtggaatgaaatacataggaaattaaggttactgctttcaaaaatttctggaatattagtacttaagtcaaaacacttacctgcagaataaaaacagcctgagtatttccaaagctgaagtaattttctgaatgttaaatatcacaagaatgaaaacagtctccattaagcacttacatgtggtttacagttgaggcagaagatgaaggtctgccaagcagttttcccatatcacctgaattctttcttcccttataaagtataagcttcaagggaaatgattacatataaaaacattccaagtgagttggggttcctgactgcaacattcaaccaaacggaaagaggaattttttaattctcctaagcaggacctacccaaccactgcagacatgagcattaattcttatgccagacaaggtaagcgtgtcctttgaaatcaaagctaagcttgacaaataactgtactggataaactggatacatgaaccacctcaacaaagatggtactttaagcatttatacacatgaaaatgatgaagtgtattatttagatatggtctttcttcatctttctctgaatcctgaaaggttagcaagtcattatactcatacatcttgtaatccctttctccacaaaatacatacacatatacagcttcatatgtcaatataatatcatcaacacagcataaagatttaagcagtagacacaagtcacatgaaagaggctctatgcatcatgtggcctgtccgaataaaaagcaaacattagaatgccatttcagcagttacagtgttgatatgatcaatatagctaatttttttatacccgtcatatatttttagaagtcatccgtagggaagaagcaaacaacaaagactgcttttttttagaaaagttatgtgccaacttcaaaatgacatactaaccagatatcagcattcgaaagctaggttgaataggactggccttgatgcacatgcagatgatttgctttcataatataaaattaaatggtaatgtcagctgtattactactgtttctatatttatgattaattactagcagtacaactcccagaaggaaggagatggatccaacagcgatgtaagcaatccccaaaaatggattttttcctcccatccatgaaatagtgctcaagatcatccgttttcgtccatcaaaataatgtacagggtaatctgaagagggtataggaagatttttccatctctggttacttgatgtttaaaatacaattttaaaagttgccatttaattgttggtaattcatttgtgtaattctaggatatacaggtacctcactcctacgttctaaatcacacacacacacacacaaagtattatcttgaaagactgatttagcaaactaaatgttagtagtaaaagccaaaatattttaccaaaacaaataaatgtaaaggttatgtagtttctcaggtgcttttgctctcattacatggaaggggcaaaaggcctcaaaggaatgcaatgtgaaaaaaatacttcaagtgaacaatgaagcccacacaaggagactgacagaccaggagaaaatggaaaaatcaggaactagaagtctccatgagctcaaagaacacatgtatcaagagtgtagttatgagactatgaaaaggctctgagcaaaagatcaaaaagcatggtaataaaaaagttttaacttgctgatttggagcaatggcaaaactcactctgtgacacagctgatagctaacagtggcagtgaagggtgggctgttaaggagatttaggaaacagggcaccagtgtactagatgaattatctacatggaccagttgtagaattttgcaagaggtaaggcagcaaagaagacagaaccaagtctccatgcaaaaagtttacaactttttcaaaagcatcttttgaatctagggttaggccccatctgtttctctagtttcttcaactctccatccccacagatgggtccctatgggtccctaactcccaatggcaggttcagttctgctaacttcttaaattaaccctaaactaaggcaggaatgattttaagacctctagctaacccaacattctgtgggatacagtatcaaattacccatgcttgtctctctctagtctcccaaacctaaagaaacaggcttctgccatcattctagtctttagttcccaccttatgcccaattttgataattaacccttgatgttttgcaggtccaaattcctgtcttatcaagtcttctcaatctgccatatatcatgcattcctttagatagttctttcaaacctgggaccctgctgcagaattcctgtatggaaatcatctatcaactaaaaattcctcagtgcttcacagacttcccttcattgtgccttaggctacaggttgctaaatttgcccttactctctagagattttctggatgctaattttaacagagctactctctagtttgactatcccctcaggataatgttatttctaccagcacttgaagtgggtctgtctgtccaaaactgctccaatgtggatttagtttcaaaaacttggtcacttttagcctgccatagcaggccatatttacttgtgtattcaggtgcaacatcaagagagtagaattcaaaaaaaaccttattttgaaattgggtctattaatttaaccatttactaatccattttaaaaccaaaacccatatggattatgactcatttggattatggaaataaaaatgcaaagatcagcaaacatttacaattctaatattgagagatctcttcactcacagtgtatgtaaaatatagactccagattaaaagatgcaaagactttggttagaataaaagaaattactgagtatttccctcctaaaaaagactgcatctatgcagatatgggttggtgtaactgagtgaactagctaagacgcaggctatgttggtagctgagagtaaaattatggcctttggagtcaacagcctggttatgaacctcaactctttattattacctgtgtaaagtcagctaagttacttaagtgctcgatattcctgtattctggtctgtaatagggagatatgctgctgcctgaattaagtaatgagcggaaaatactcagcacagtgttaacacatagttagagtggaataaatgtatttatcagcactgaatgtgaacttattaatatggaacaatatagctaataataaaatgttttgatactaccaatagatcaaaatcatgaacaattacattgatacaaattaacacatccgttgatttttaatatctaaaatatatatattaaaacagcccagtaccactcaacacccaattttaggtactctcattggcctttacattaagcccaattacaatctcccttgtaaaaatacctagcttgttaataaaacaagcacctatattttaagtaattttaccaaacaatatgcttcaaaccccagtaccaagtatatgcgaattcaaaacatttctagaagacgtaaatttaaaaatacattctcacatataccacacatacttttgtaaaaatgcagagaccaaaactaaagcacaaggtaacatgccacataacagatataaggttggactcgactcctttcaagctctatgaatctgtatacccagccaaaaaaggatactgtatgtgacattcaaagagtatcggccagctggtaatgttggatgtaaatcacttttcctttctataagacgatacaacttgcgaaaagtaggtaatgctgcagtacgcatccaaacaataaaatcctcatttatgaatccattattatctgggtcagaatccagcatgtaaactggtttaagccagttcacaggctttgttgtaccttaaaaggagtggggaggggataaggagacaaaatattacattgtgaaattaaagtggcggagaaacgaataaatttggataataaataggggtttattcaaaagaagctttgctgcaattttaaaatattatagctgaaatgcttataagacatcacagaaactgaattcataattaaaagtatacatttcctttagaattttagtacattagaacatttacctaacttggtatgaagctgaggaaagaaaaattgtgtttttcaaagcataactttaagattctgaagatagaaaatttaaaatacttcattaaaactcctagtttaattttttaagggatattagtaatgttttacctttaaatcgttcttccaggttgtctcctccagggggatttctgaatttcacatttttatctgtccaccaagcaatacctttctttttcaaagcgataggtataggataagaatcattgccaatgagaaacaattctaatgtatctaaacacaagcaaagaaagacattactaactatctcttgaaaactcatagcatctgcttaactctatgagaaataaggacctgatatttgtttccaaaagtggttgtgacagagtaggcatatgattcacatttgttctttattcctatgtggattaactatggtaactttataattctagatggacttctcttcctttaacagagttctaattcagttacccataggctagctgacatgcagtaagatcaaatgttttaatattaacccaactataattgcaaggtaaatctgcatttccttccttccaataatgcatccccaatagcttcttgcttatccatttctgtttgcattgtctcatacaacagccactaggcacacagggctactgagtctttcatatgtggttggtccaaatgagtatgttctataagtgtacaatacacatcagatatcaaagacttagtataaaaaattagaatatgaagtatctcaacttttatatagtattatatgccgaaataacagtatcttggatatactgttacataaaacatattgctaaaattaatttcacttgtttcttttcatagttttaaatatgactattagaaaatttaaaattaccaggccaggcgcagtggctcacgcctgtaatcccagcaacttgggaggccgaagtgggcggatcacgaggtcaggaatacaagaccagcctgaccaatatggtgaaaccccgtctctactaaaaatacaaaaaaaatagccaggcgtggttgcgggcgcctgtaatcccagttacaggggaagctgaggcaagagaaatgcttgaacccagggagcagaggttgcagtgagccgacgtcgcgccactgcactccagcctgggcgacagaatgacgctccatctcaaaaaaagaaaaaggaaaaaaaaaaaaagacagaaaatgtaaaattacctacaggacttgtatttatagctcacattatatttctatcagatagtgctgctctaaatgatcaactatagctccttttcaatgataaaaatgaagtcagtgggaaggtcagcctgacttttatttttatatgaaataagattagcagaatgtttctgcttctttcttctcagagacagaaatccactctaaaatgtaagtatgctcaaaagaaaatcacaaatcattataataccccattcaatactcgatttagtcttaaatgtttgagtttctcaatttcattcatgtttactaaactatcaaatctgtaatgaaattatgcaaattgtcctaattatatatgtctatatttgtatctatatcataccattaaacatgctgttggcaatagctccacaaggagcaattggtttgtcttcatttcttcgataaggttcacattccttactgggattctggtttttacaaggaaaagaagagagaaattattatccaggcctttgggagaactatgagctatccctaaattactgattaagaattcaacacctatatttttctcacttataatacacaggtctgtaatgtaagtaggctatagataacaccacatttaaatattcaaaatgtattctgaacattactgccttacctttttaatataacctttacttgcatatgttttgtcatatatgcatatatcaaataaacatctttttgattttcttatcacagaaacattaccacaaagggttttctgcccaagaaaaattaagaaatggtctattgccaatccagttgtgatataacaagaaaatcttaaactggaactaaagaggctagaggttctagttccttgggcaattcctttaatttaactgggcctcacaaaataaacatgtccaactatacaatctgaaattttgtgatttggggttaaatcctatatctaagaaaggaaggaaggagtctagtgcagattcctagaatatatcaatctttaaactgtgcatccaggtacaagaaaaacaaaaatgctgacaaggcagaacatttgcctgtggtccagattttggttttgacttactccctactgaggatcttaaagaggtgtggcagttatgggattcaactagagatcatatcaagtctgaggttaggggtctgtctgagctgggaccctcccgccacattaagccatgtctcaaaacacataaacataccaagataatctcaatttgaaattaagaggaccctaattagacctcttaggactatttcattaccagctaaccttgacttgtatctatattctccatgtctagattggataaaagcacttgtgtgaatggaaaagataaggctaaggaagtctgtggtaggtatctcataaagtctcttcaatatttgacttctcagctttttggtccctacaccatctgtattgataaagctattaacaatagggcaaatatatctgctagccactaaattcttaaggaagttttaaaagaaaggaaaatagtatttactatctatgtgtcaggtactaaactaagcaatgctaggtactttgcattaactggcttacaaaagctatttgatgagggccgggtgcggtggctcatgcccctaatttcagcactttgggaggccaaggtgggaggatcccttgagtccaggtgttcgagataagcctgggcaacatggcgaaatcccatctctacaaaaatacaaaaaattagccaggcatggtggcgtgcacctttagtcccaactacttaggagggtgaggtgggtggtttgcttgagtccaggaagcaaaggttgcagtgagcagagatcgtgccactgcactccagcctgggtgacaaagtcaaccctgtctcagaaaaaaacaaaaacaagccgggcacagtggttcacgcctgtaatcctagcactttgggaggccgaggctggtggatcacgaggtcaggagttcaagaccagcctgcctaagatggtgaaaccacgtctctactaaaaatacaaaaattagccgggcatggtggtgggggcctataatcccagctactcaggaggctgaggcacagaattgcttgaaccggggaggcagaagttgcagtgagccgagatcgcaccactgcactccagcctgggcgacagagtggtgagactccgtctcaaaaaaaaaaacaacaaacaacaacaacaaaaaaaaacaaagctatttgatgagtacctaatatgcagcatgtacaatactaggtgctaaaaacagaaaaacgaaaagaatacaatccctatttttaagcaactcaaaatgtaacaggggaagcagacccttacaaaaccaactatcatacgaaataagagccatgatgaagatgtctacattcattcagcaaatatttattaaatgccttccatgtgcaagcacgagccaggcacttggtaaacagtgattaaagaaagtcatgctccctgccttcatgagcttacagtatagctggaaagaaagataacagataagcaaatatgtaattacaaattacagtaagtgttatgaagaggctatgtgagtatttaatggaaaaaggataggaggagctgctttagaatctatggtaatgaaaagtttgactctggaggaggtatcatttaagttaagacataaaaaaaagaccaggagccagccatgtaaagagaagacagaagagagttttaagcaaagagaacaccacatgccactaaacaagaacttatttctgtgaaggtaatggtgaatgtagctggagcatgccaagagggaggatgatatgtgatgagataagaggattacgcatagctcagatcatcctgagattttactacaagtgctaatatgaccactgaaagattttaggtagggaagtgatatttatactttttaaaaacttcactatagctgctatgagaatggcctggaaaggagcaggattggatgatgtgagacacaatttgttcatccaagcaaaaagtggtagtgacttggaacaaaaaaataaatgaagtaaatatgtaaagaagcacatttttgcatggaagggcacttagaaaaaatagcaggccttgagatgagaagacctccagggaaacagtaaaaatgacattctaagcaaataaaatgctaactggcaaaatgagcagattacttgtgtcacaatgcatggttagggagcagcaaacaaggcccagggcagccaggccttgtttaatgtattaaaaatagtatataagataataaggctgatgccagattgtacagggccttacacataatatctgaccctttacagaaaaagttgatctattcctggtgtggcctgaaatctttgcttacagtttggaagaaaagaatcagtttcagttttctttaccctcagtgaacacagcacatatataaataaaataattgtaaatcagccaccatttctggggttttggaacacacactatctataatccctaaaaaacacattcagaaaggtctagaaacttggtgtatctcacagtacaacatcttctctggatttgagtgctaaaaattggatcctatggaataaaccccacatagattcaaaatatcataggcctaaccagaaccctgtgtataccaaggaatctttaagtagacttgtattgcttaaaatcccacacatcagcaactgatgatcagcaataaaaccaatcaagataacctagagcagttatattttacatttcggaggcccatgctgctcacaacatagtcctaaattgtattctaagagattcattaattctaagaaatcctaaattgctctgggcctctgaatgtttgctgcattggcaacagtaacataaaatacttagggccggacacggtggctcaagcctgtaatcccagcactttggaaggccgaggagggcagatcacctgaagtccagaatttgagaccagtctggccagcgtggcgaaaccccgtctctactaaaaatacaaaaattagccgggcttggtgatgcgcacctgtaatcccagatactcgggagactgaggcaggagaatcacttgaacccaggaggtggaggctgcagtgagccgaggtcgcgccactgcactccagtctgggcaatagagtgagactctgtctcaaaaaaataaaataaaataaaaaataaaaaaaaatacataggcactaaccactaatatggaaaactgaagaacagtaaagaaactaagatcccctagtccacagatttccaaaccagtctgggcatcaatgcatctgtgtgaattccaggaaaaaatattttaactaaaaatcctcatgatacaggccaggcatggtggctcatgcctgtaatcccagcactgtgggaggccgaggtgggcagatcatgaggtcaggagtttgaaagcagactggccaacatgttgaaaccccatctctactaaaaatacaaaaattagctgggtgtggtggtatacacctgtaatcccagctactcgggagactgaggcaaaattgcttgaacctggggggtggaggttgcagtgagctgagactgtgccactgcactccagcctgggcgacaaagtgagactccatctcggggggaaaaaaatcctcactatacaaactataaatgacaacactttaatttcatcctaacaattctaactgaacagttactacatattcttattttacagatatcatattttcatatttatcattttacttacaagcaaagcactagaatctccatttagttgactatcatctcgagatttcacgtaacgacgatggttttgatagaaattagacagtccataatacataaacacgttgccctagagaaacagagagggaaaaaattttcatataaaaactattctgtataaacttatttcatgtgtacataaaagctacgtaatttggacttttattagtttacaatttgtgataggtagtggggtaaattccaccagtacttagcaatctaaaatggcacaactgtaaataaggctagagaaggtatgttacaaaaagccacaagtaaactttaaaactatccttaaagacgtcaaaaaagtactatttacattaaaagagaatattcaaggaatctattagcctactctgagctaccttcaatttaaaattttctctaattcaaactggtcttcacccagttagcatcgacttttcacagggataatggtcaaacttgtttcttttttttttctcccagagactagagtcttgctatgttgcccaggctggcccttaattcctgggcttgagccgttctaccgcctctatccctagacactgggaggtgtgcactacaggtctgtagcaccacgtgcagttgaaactttcattttttttgtccaagtgaattctgaacttgaattgggatataataaattcctcaagaggacactatataatattatgagttaataaactactaattagtagagtctctatgataataagccactttataataatcaagaaaagtactttaatatatttaatagcgccaactttgaaataacctgggaaagaagggtaacctataaacattacaattatttagaagatgctaagaagccatcttaaatgattaaaatttttagaggtagcaaacattaaggtattttctcctttctggttgctacctctattttctatattcttatccttaattaaaagtaattcagtaacattataagtagacttcatttgatttgctatttttatatacactatcatttatttaatgcttgactttcaaatgtcaaaccatgcaaattttcccattctatataaagaaaatgtttacatggaaaccttcttgtggaagagagggaatatcaaaattacatcacagaaattgagaaaatgaatattcttttttaaaaggaaatattacctcgagattcagtacagtaaattcaatttgtaaactgaaaaagagattatttgaatgaacactgagataaaataacctacttgaagttccctgaagagtttagtccaattcaaagtttgagcttgtgaagaaacacagagtccacaagagaatgaatttgaggttgactgcctttgcaaaaaacaagttctgaagtgttttttgaatgggagagaaaattaatagagcttctatatcactactagtctctcgtttcttcaattctgcctgttctgacaaaagcagaatttattgtatctttattgtctgcccatcacactgaaaaatcatggacttgtaaagatactttaaatgtatattctgtttctgctgaaacaaagttaaataattacatttgtcttctacaaaatttgttttcatgtattattcaaaagcagcatgatcctgtcctttatgtcagtgcaagagcatctataaccactagatggcaaccaactattagggactattaaagtcatcactacctttagaaaatcttaagttcagaaaatctaaaaagttggcatgtattaacgcagttttgctcccttaagaataattattttaagctcaattttcaggcacaggagaatacagagtggtctttacatgcctattctgaatctttatgtccgttagcatgtattcagaatggcagtgtaaatgcaaacagatggatttctaactacttataaaaacataaatgatcagtaaggttttaataagtgtttgcattttttataatgcttcatatgtcataaaaataattcaattaagtaatgggagaattatttattttctaaagtaaagcttgctttagtatcgtaagtatgcacaacaatttgagcaataattttaaaaatacaagtatataaaacttgataaaaaattgattcgtacagtcataacattatctgttgaaaggataaaatacaatatcttaaattttgtctacaaagtactaactaaaccattcaaataaatgtatttaattaccagacagcaaaatccaacagccaaacacacaaaacgatcttcctcaaaagcctataaactccagtaaattatacagacttctctataaaaggaaaataccttgtaaaagacatttagtacagtatcagtattttttaaagcatggcttttctagcacattacttggaaacacagacctcaaatgacttttccagtgtgaagttaatggtacaaaagcaaggtgtcacatccggagataaacatttattacagggactggaaggctctgttccggtataatcaatctgcaagagaaaaatataactaagcacttccttagagaaagtggatacctaaaacactctgaaacgacttgctattaaaaggaaaattaagtccaatgaaatgacctagagctcagacaaaaactgtttttaaggtcatctgtttgacagtgtgaggtagtaaaaactggaaagggtcctctgttgttctactggctgatctttccaagtaaagtcctctcttctttttatcaaagaaatatatttatgcataaaatcatacatacaaaattcaaaactgcatatttacatagctaaaacatctaaactattaaaatactagattaacagagatcaataaatcagtttttcctcttaaatctttcaatcttaaatacttttcagtcacctcagctttccattatatacttttgaaaaaaattaggttaccaagagctactgttttttcaacacctggtgctgaatttgtctttgtcttgggttcccggcaaggagctttatgcttggaatttcccaggtgacagaagtatctttgttattcataagccccttgattcacaccagagtttatgttagttaacaagatgactcaggatagcagctagtcaccagaaagactaattgtgtgattgcggacctttggcccagcccaatctcttaggaggaaagtggggctaaaaatttagttcaatcaattagtcagtgttcaatcaatcaagcctacatcatgaagtcccaatagaaactctagacactgaagtgaaggacagctttctggttggtgaatccactaatgtgctgggagggtaatgtgctctaagtatacagggagagggcataaaagctctgcattcaggactgttcgagaccttgctatatgtgtcttctaggaccccctctgaatatatagccagttggtcagaaatatgggtgacctggagatccctgaacttgcaaatggcatctgaagtgagggaaatcttatggcgaggtagtgagaatggtcttgggaactccctggatttggagccagttgacaagaagtatgagtggcctgggaacttgaattgcagctggtgtctgaagtgggggcagtcttgttggggaccatgcccttgaacctgtggagtctgacactatttcaggatggttagtgccagaattgaattgcagtatactggttgatgtcagaagatctggcctgatcgctaaattgaaaggcttttttttccaccataaacatttttaaatagactaatttttatagtttaaggttcacagcaaaactgaacaaagtacagagttcccatatactctctgcctctgacacacacacacaacttcccccactatcaacatctcacaccacagtggtacatttgctataatcgacgaacctacactgacacatcaccatcacccaaagcccacagttcacactagggttcacacttggtgtatattctatgggttttgacaaacgtataatgagtatccaccattatgttatcatacggaatagtctctctgccctaaaaaacctctgtactctatatccctctctctgctaacccctggaaaggactgatctttttactgtcctcatagttttgtactttccagaatgttatatatgaaatcataccatatgtacccttttcagattggtttctttcacttagtaatactcacttaagattttaaatgtcttttcatgggttcatagttcatttatttttagcaataaataatatccactgtgtggatgtgccacagtttattgatttgttcacctactgaaggacatcttggttgcttccaagttattgaaattatgaataaagctgttaaacatccatgtgcaggtttttgtgtggacattagttttcaacccacttggctaaatacaaggtatgcaattgctggatcatagagtaagagtatgtttgctttttcttttttttttgagacggagtctcactctatcaccaggcagagcgcagtggcacaatctcggctcactgcaacctccgcctcctgggttcaagtgattctcctgcctcagccttccaagtagctgggactacaggagtgcaccaccatgcccagctaatttttgtatttttagtagaggcggggtttcaccatgttggctaggatggtgtctatctcttgacctcatgatccgcccaccttggcctcccaaagtgctgggattacaggcatgagccaccgcgcccggccccattatttctcttaaattcttattttggtcttgatctcctgacctcgtgatccacctgccttggcctcccaaagtgctgagattacaggtgtaagtcactgcgcccagctgagtatgtttacttttgtaagaaactgccaaactgacttccaaaggagctataccattttgcattccatcataattcctattgctccacatcctcccttagcatttggtggtgtcagttttggattttcaccatcctactaggtatgtggtaatatgtcattgttgttgtaatttgtaattctctattgatatatgatgttgagcatttttatatgcttacttgccacctgaatgttatgaactgaatgtttgtgtccccctaaatgtcctatgttgaagctctatcccccagtatgatggtatctggagaaggggcctttgggaggtaatcagatttaggtgaggtcatgagggtggagctcctatgatgggattagtgtccttataagatgaggaaaaaagaccacagctctctcaatctctatcatctgaggacaaaggaagatggcagccatctacaagcctgtaaagggacctcactaggagctgaatctaccagtaccttgaccttggacttcccagcctccagaactacaagaaataaacattggttgtttaacccaaccaatggaaggtatcacccagctgattaagacaccgtagtactccttggtaaggtgtaacatttagtggctttttaaaagtcatacatttgcttaacaaaacttggttttgtcaaattccagtataacctcctatagaaacagttttcatcaaagcttatttgtttactgatgaaattgtttagagaaacttttctttcactgcataattaaagaagagctagtcacataactaaaacaaactgaaaacacaggtctcccaaacgaagagaggcaaagcctatgtaatctttcattagacctgttgggccacaactttgcacctggggccttttcatgcacaatattccacttaaataccaagttttatgatgttggagagatgaaagaaaagaccattcagaaaaacaaactatattttaaaatctctgtacattttctccctcttaagactaatctaagcattaaaaaaaaagttgccagctgaacttattcccatattatacgcttttgaacagaaacctctcaaatcactgtttagaattagtttctaggggcaaaatctgcaagagaaatcatattctttttttaactgaacaaaaataatctgatggaatttgaaatctaataaattatgctacagtataaaatataacaatataacattttattggaaccaagagtaatcactgaatattaaattacacatgaacaaaatgaaagatagctataacatcttcatcacaatctgattatgattttttaaatgtattaaaaaattacatgtcttttgatgccatgaaaatctgaaaggactatttaaaaaaatcattatcattaatatattaagcctatgtgtaaggcatgacattagatacaagatacacacaaaagcaatcatacgttatacagtttacacagcctgttccttcacatacatatttcatctgaccctcaccaaaattctatagcattatctccattttatataaaaagaacacattcagaaacttgtccaaggtcacacaagtagtaatagctagtgctaagctggaaccaaggatttctgactccaagcctcatgtttcttctactaaaccattttttcccccaaaatagtcagtcccctttgccctctagcagactactttatcaaagataacatataaataccaagaaaactaccttaaattctaagtgccaaactagatggcatagaggaataatagatggaccaacacttctttcttactgagaagcagcaaagatttgaacagagccataaaagaaagatggaaaagagagaaagaggtggcatatggagaagacagaggtggaaatcacaaggtatatttaaggacaatagcatacacattttgtatttatggagttttcatgttggaaggaaatgaggcagctaagaaggtaaactggacccaaaactatatactgtatttcactgactactgtttattgaatgtatactaagtgctgggcattgtaagtacttaatacacatgtagaaagtagaaaagctcctcttcaaagctcatcttggtttaaaaataaaacaatagacactagaaataataacttcttactctaaagcctcctatcaactattagttcttacactttagcccagttagttgcttcggcttactcaggcatgcctggacaagcccaagcaagtcctagctcatagcttatgccccttccttatttggaaatgttattgcttccttaaacctttcataagcaacttcctctccttctttgttctcccttgcacttacctatttaggaaagttttaggttattagcaaatcgggtatcagtttaaaactgtgaggtccagctccagccaatggatgcaggatacgacagtaaggatgatccaaatgcataagggataaatatgttgcttttcctttgttcaagtgtgctctcaccattgttccatcttcaaggagcgccctttctgcagaaagtaaagactgcgtttctgagaggtcctctgtctctatgctgacttttcttcatggcactgattatctaacacacatcatctcattttaaaaatacaattaccctggcaattgctggaattgtttccaagttttgtggaactgtccattgtgagttttggaaggatgcagggctccacctcccacttcagaaaccaaagggagagatgggttcttcctctccataaacccatggtagccagtgtaaaggtacaagagctagactcagcaatcagacactcccacatagaccagtgaatcctgggaaacaaagagtggatgtgattaaatgagcagtcacagtagtagtctagcaagagaaattcaacagcagctgtggcatctggatcagactgtttatactttcaaaactcccttacttcccacttgtctccaaacctgactctctgtacgtcccatccattttgtgtgagagttacccaatcctcctttaatactttctttcctgtctaagctagccagagctggttactgctgctgacaataaagcctcagcaagctaagtaaccgagtgttaaaatgtccggcaggaaataaggaactgaagagttttgaggagaacaacataatcaaatatttgcatataaacagataggaaataggactttcatttctttctgactgcccatcatgacgtaatcattcattcacctaacatttatgaatgcctctatggtcccagcaatgaggattcagcctagcacctgacctcctggagttcagtatctaacacagaaaacaacattaaaatagaatggatatttttattaaaaaaaaaaaaaaagtataggtggtatggcaatacaagctagtctagtagtcagcaaatttctccatgaaagctgccgagtagatgttatctacagggagagagtacaaagagagactacatccctgactgggggcttggaacatgatatagttttgatatttgtctctctttgctgcagcatttgccaaataacctgtttgttaaattttcagcactctctagattactcttcaataggcaaatttgttttgcctttagatatggatggatatcacagttatacaagtttgatttatagtatataatattttccttgggtaatttcaagaactccttcagacccataataccattcagatgaccaaaaaactctcaacaaactgtgttaagatgtcttgatggtactgactgagtttcattcactcattcaaacctgagtccctattaggtgctaggcactgtctacaggatgagaatacaaaatggaaaaatacattgttcatgctacaaaagaatttacagacaagtgggatagaaagtcacatttatgaataattacaggataatataattttaaggcaggctgtaagctagtacttctggaaactgagagaagcatatataccaggtggaaaaaggagaatcaaggaagactttccatgttaataggaactgcatgtgaaaatgtgatagaataagaaaaggaaggtcatttcaggtaaactattagcatgtcacattccagaaactatagtagtttgccatgactagagcataaggtaggggagtggtaggagatgtggctagaaaagcagaaagtagcctatcatgaagaaaattacactctatgtaaaggggtttgaacagtatcctgaatgctagacagaaacagccataagagaaattttaaataaaagaaggaaacattaaaactagcctctcaaaaagaatcactgtggcaccaatgtgcagagagattaaagagaatgccagacagaatgccaccacaataatccaggtgaaaaatgttgagaacttaaactaataaagtggcagcaggaatacaaaagacagattcacaaaagaaagagaaggtagaatctacagaacttagtgcctagagatgggatgagggcaaatacacttaggttgatttccagggtttctggcatgaaaaaccctatggatggtgatgccactctctgtaaggtttaccactgcttttcatgtcactaaatcaaaagtcagttctcaggccgggcgcggtggctcacacctgtaatcccagcactttgggaggccaaggcgagcggatcatgaggtcaggagatcgagaccacggtgaaaccccgtctctactaaaaatacaaaaaattagccaggcctggtggcgggcgcctgtagtcccagctactcaggaggctgaggcaggagaacggcatgaacctgggaggcggagcttgcagtaagccaagatcgtgccactgcactccagcctgggtgacagatcgagactctgtctcaaaaaaaaaaaaaaaaagtcagttctcagtcctgctcttctgtgaaccatgagcaacaacatttggcatgttgtttacaagctcttcctttgattccagggtaccagtttccatgtttttgtcctacctcactggctgctccttttcagtctcctttgctagttcctccttagctccccagcctctaaacactggagtgactcagggatcttcttacttttctttgacctataaatcactcttatgatttcatcctatcttaggcctttatacaccatctatgctaattaggcctttatacatcatctatgctgattaaccctcaaaatatgtaactctagtctcaaccttccccttgaactctatatttgtttgcctactcattattcccaacttggatgtctaatggcatctcatcctaacaagtcaaatattgaactatttattctgcttcccccaccacatcctcttactagcatacttaaaacctcattttcctacaatcttccccatcttgaaaaatgacaactccatccttccagctacaaatcaaaatatcttagtcatctttgattcttcacttttctcttacaccccatatatcaattgcatgagaaaattcttttagctctactttcataaatatattctatatctaactgcttttcactgcaaccattctactgtgaccaccatcatctcctgcttgaattacttgcaatagcctcttaactggtttccctgtgtgatattgtgatttacagtaagaaatacatatttaatctttgctcccagtttcctggtacagagctcctaaaaaaaactcttacagtctctgagtgatgagtgtctttcatatgctaatgatacaattggtggttggtgccccctaaatagcttcaggatggaagctggtcactagaaagaccaaggcatgaatagacctgtgggaaggggaaagggactgaaggttgagtcccaggaggcagagtgactgaagactgagctgatcaccaacggtcaattattgagtcaatcatgtgtacataatgaagccttcatgaaaactcaaaaagacagggttcagagagcttccagatagctgaacacatggaagtgcctgaagtgtggcaccccagtgagcacatggaagctctgaaccccttctccaaacatctccttttacatctcttccatctggtttttcatctgtatcctgtgtaatatcctttataataaacgggtaaacgtaaataaagtgtttacctgagttctatgagccgctctagcaaataaagcaaactcaaggagggcgtcatggaaacaccagtttatagcaatttggccagaagtacaggtcgcagcctgggacttacaattggcatctaaagtgagaggcagtcttgtgggactgagcccctaccctgtgggatctgatactatctcctagtagatagtgccagaatttaacgaaattataggacacccaattgctgtgtgctggagaatctggtgtcagaactggatggtgtgtagggaaaaatttccacacatgtggtgtcagaagtgttgagtggtgtgcgagactaggaaatatgctttggctttttcctgtcagaaataccctgctttactcttatttaccaggcaatattctccatgtcaaggccagagtgattctttttaaacataagtgaaataataacacctatctgtgcaaaacttttcaatagcttctcactaaactgagcggagaagccaaagttcttatagtgcttcatgtgatattcctcctaatacttcccaataccctcatcttctaccattcttccccctctacttcagccatattggcctctttgttgttcctcaaacacctaactaagcacattcctcaggacctatgctcttactatttcttctgcctggaacattcttccctcacatatcaatatggttcactctcttccctcttttggttctttattcaaatgccattttactgaggcttcccctggctaccctatttaaaattataaaccatcaacccttccttcattcttcttcataggattttttaccatttaacatacttcaaatgcagcaaattaaggagttaaagggagatgggaatggacattggcaataagcacggacccttctttttaaacagattgtgtggaaagagaatacaggaaactacaggaaactaaacaagaggtcagatggctaaagtatgaatcccacctttgtgactaagcagaagacttaatctcagattcaatgtcctcatccaaaaaaaaaaaaaaaaaaaaaatggagagaataatgttacccttgttaagtgtcactgtatcaactaacatgatgtatgtaaaactcttagcagagtatactctcaaaaaatgttagtcattattaatagttttattatgaaatacaattaagccagacacagtggcttgcgcctgtaatcccagctactcgggaggccgaggcaagaagatcacttgagcccaggagtttgaggctacagtgagctatgaacattgccactgcactctagcctgggcaacggcaaggccccatctctattttttttaaaaaaaggccaggtgcggtggctaacaatgcttgtaatcccaacactctgggaggacatggcaagaggactgcttgaggccaggaggtcaagagcagcctgggcaaccaagcgagacccccatctctagcaaaaatttaaaaattggccagtcctggtggcatgcacctatagtcctagttactcaagaggctgaggtggaagggttgcttgagcctaggagttttgagtttgcagtgcgctacgactgtaccactgcaatgaagcccaggcaacagagcaagaccttgtttctaaaaaagaaaaataaaataaaaataaaaggatatttttgttttttaaggagaaaccaaaacacatttatatgctgaacagagatggaaaaaagaggttgaagaaaacaagaggaagatggtgatattcaatactcctataactttttttttaagtatcagcaaagccacatacctaactcacttttcacatgaaaaaacattaatgagtttcactatgaaatcaagttggattcaatattattataatcaatataaaaatgcaaacattaattccagcgtctaaactactactctcacgtctatatgagatctagctctcatcctgatgacataccatttcaccaccagataaatcttcctctaaccctgtgttgcagagactgctaatagcaacccctcgcctcaatttctattctatctttttttcacaatacaaaactctcacttactgagaaccttgttatcagaatgaaaacattttccagcctcccttgtagcttgtgtggccttgttactaagtggaggtggtacatgacagttttcaagaaccttctttaaaaggcctttatctctttgttcatcccttcttccacattgctaccgtgaaaaggcagttagaaccctagcttccatgccgaactgtaagcatgagagccagttcctaagaatggctgggcagtaaatgattagatcaagtgaagactcagtaaaacagaacctccatgacagcttcacactatgttcctaagccattttacatgagactgaaaatcataattactcattgctcaacccactcctaactgatagtgtagcaatcatgtcacttccctcgtttaatatattcattatcaaatactcaagactatccacaatctagcaccagctaatttgctcttactcctattttatctatacactttttgatttcctgccactagatcgttgttcatattaatcacctttcttggaatgcatccaaacctcccctaaagaagtgctatttatcaagtaccagctcaaagcccacttcctacacagtgttccatggtcattagaaatagatgtgattgcatcctcctttgaactaccaaaggatattcttgcctgtgccactcacctagcaatgcttagttttcttgttattgtgtctcatcttccccaaaagatgccaagctccttaagaaggtcctctgctccaaaaaggtgtgtgggggggtgggcagggagggaagtcctgtgcccaaactttccctatctcccactattcccagagatgcactttgaagaaaatgtatgaagacaatgtccaatgttgattaaaatcctttataaatttaactcagcttatgagttttcaccatcaaataaaaccacaacaccctttatcagctaaaattcaagggtagccagacataatgtccagaccttaataaaaccttatgggcctaacaatcctttattttttgaataaagttgttaccatgggttgtaacaactttattcaaaaaataaagttcacactaaagcacatagttcctatctttagaaacaaaagaggctaccaagtggaagacaagctacagttctctcattttgaaaaattaatgcttactaacgtcaagagcatacaaggcacagtgcaaactacaatgatagtctggagacttgcccattagctaaaatccaagacaaagaaccagaggcaaaatagaacagatgtagatgagcagataggagatatcacattctcagctttgttttgctaccactgtaattgttcacctaagtcaaactggcatttcttcttggtaattctaaaaatacattatatttctaagaaacagactcagaatttaatgcagtgggaaaggaggaatttgaaagatgcgcattttttacactatataggaaaacgactggaaaacttccattttgaatgtaaatttgtcaaaaaggaaatcaacataagacctaaacaggtcattcaacaaaatgctgagtaataaggtaaatcattttaagtattaatcaaattaagttaaaaatcatattttaagtactcccccttgaactgattattccacactaaatgatttatctgaagtcttttcgagagaccttaatgaagacaaaaggtaagtaaaactttcaaaagcaactttctttaggctgcctgattgtctgtgacaaagaaatgaagaatgatgttcctaagccaatattaatggtaaattttatatctactaaatctgtacaaagacagaacctaagcaattgccagggatcattacacctatcttgaacaattattgaggactagaacatgtaaattaaacacagctatttgtgtagcaaatgctaactttgctggtatgattcattaaaactctaagtcatgggcaggcaatttttttctgtaagaggccagaaagtaaatacttcaggctttgtggacccagaagcatggtccaagatattaggtatgtaggttcttatgtaacaagagagaaaacaaatttgcaacaatttttattgataaaattcaaaatgcaacaataatatgtacaattttttggtaatataggtctactaatactaatgagaagaatggaaattttggaggagacatttctcataattgggattcaaagttagtgctctcctatcatcaaatcgattacaaatgttcatctgttaaatgttcctgggccacgcaaaacattccagctggccatatttactttcgcattccttgctctaagtactaacattacttgagaaacaagttaaaacaccacaaaccttaatttccaaaagtcagcttctaagtaactaaaatcaacttgaatattaaaaccttaaactttttaacataaaagtgcctaatctttaacgataatttatacaaagcaacttattcttccctgactcttagctaaagcctaagtataacaaagattgctaaatacagatgagaaatttaatctccttaaaaatcttataatctaataattcaatttaggagtaaaaacatacataaaaatttttatcagaaactaggacaacagaaaataatcaggattaaataatcgagggcagtaaataaaataaggtgaagaagaaagttgagagtttatcaaacgtggggaatggggagctaattcactaagatctcatgaaaatgtaccttaaatgtttttggcaacactaacttgaagtaaatgtttagtttttaaacttagtctgaataacaacctaatctgacttaaaccataaatttaaaactatgtaacttcacactgatacttttacaaaagttaagaataacctcactatatttttcaagtaacctctgtatctcagtctcaccaacaagggtcctagactagaaaatcagtgccctttgaaagatgtgcctgactcacaattgccaaattaaaggaaatcttcattccctgctcctgataataaatgaagatattaaatatttaaaatattttctcgtgaatgataaagcaattatgattttctattagcctcattttatttagattattgaaaatctaaaaaccaactaaacaagatacataaacctaaaaagtagaggaaatctgctaccaaatgtaagcattaaaatgtgaaaatatcttttttttccaggggtgtccaagacacttttcaaaagtagtaatttttaatgtaacatttctgcgggaatgagaaaaatccagtgattttatacttgaaaaagtttggatttttgattttggcactttaagctatattaaaaaagcatttggatttgacaagcctcctttgccctagtaatctgaactaaaatagcaatgaaggttttttaaataaaaaataaagtgtgagtaacttacagtatgaaagtgaatgttggtaagaacttctcattacccatttacaactagtgggtaacaaagggtagagaacaagcaggaaacaagtatgtgtgtttggggaatttccagacacaattcagaagcatttctctatacatttagcatccaaactttaaaaatatatatgtggattctgtctgcacaactgtatgtcagtgtcagtaaaaaattcccaattattcttaattttcatttcctcctgtttcaaaggcaatacaatttaaacacatcctgcttttttaaaatcacatttgaattggaaatcatagaattttagagttgaacaacctcttagacgcagtctaatctgaatcttttggctcttcaagtaaagaaattggactcaaaattatacctaagatcacaaagtacagagtgacagagctgggatttcaaccttaattccctgactcttcagtgcccttttaaccaggctaagctgcagcagattcttcaggcaacttgaaatcagaattacacatgagagccatttgaaaaatttctatttcgtctactacttagcgtgaagaaccttattttactccaaaacccaaagattttaagaaaagttaaatatttatttttatactatagtaaatactaatggaagctgagttctgaaaatactaatttatatacaattccaaattattgctattttcatcttattatcttaagaagtttaaataaaatcattcaaatttctgatgttaaattattttcttctactttactaacattgcagtaaaaggatcttagtgtagggtgaaagcttaaagctgggaatcaagacacctgagtttctgtctcattttttacaatactctcaactagtttactgtcaaatctcaacctctctatttctcttctcctgattaaggatcaggagacagatccctagtgccagacatcttatttatattgcttctaattctcacaccttagaagatatgaatgattctacctattttgcaggaaactgaagctcagagagattacggaaattttccaagaaactgagctggttagtagctgagctggaatttaaaaccagctctgcctgaccccagccaatgcccatgttccttgcatgacaccgctttgcccatatcctaatataatgtgggatcccagtatggttagaacaagtactacatttgcaggactattagggagattaaggtgataaaacaaactaaaatacatgctgaaaaaaaatactgtaactctctagttattaaattgagaatgaatttttagtaaaaaactttaaaactagttattctatagatactattcttattactgtcatcaacactgaagtaagcactgtagaattacaaaatacatcaatcttgcttttagagataacactgcaaattaaactggaaccccatccctatttcagtagttaaaaataaaattactctcaaagtcccattaaatcacaaagtatatttattaaaatgtgtgtgtgtgtgtgtgtgtgtgtgtgtataaacagaacagaaggaatcaagagaacttggtactagttcctgccctttcaaatagatttagaaaaaaaaaaattctcagatatgcaagaaaagatgagagatgcttaatactggacacctatagagtatatattaatacagtgtactgtcaaccgtcttcgcccctgcagataaagatactgtgctttcgacaaagaaatgtttccccaagttttcctgtcatgtcttacacattcagcaaagttaatatcagtaaaatgtttggtagacagtgcacaacttactccctgagtgtggtcactggctctttttgtaaaaaaaaaaaacaaaacaaaacaagacaaaacaaaaacccagcaaaggtagggcacattaataaacgtagcctaaaagcaaaaccagaattgaagtttcaggttatcttttatgtacatcttgccctacaactaaaaatatcgaattagctcaaaatgaaaagtactatgcacatttgtcataagtcctcatatgtgacctgataacatgcgacagcttctttacattagaatcgtcaatacctctacgactctggttcttctcccaacaatggccaaggtgtccatctctgtgtcttgggatacttcccacaaaggtaatggcactttgaccctgtcaattcactcagggttacatctacctagttacaattgccccccgcccccacttctctttttacctccgtgaacaacccccactaatcccccacggaaccacacaaaccgcccactgaagaagcgttctccacctgacctatcttctgcattaaacattcattccgtctcagctcattccgtggatttgctctttcgtaaatctcgagcaagacaaagctaggacaaacctgcaaattcaggaaacccgcagaaagagaaagaaaaaacagagaaacagagggaagggggtggtggacggcgcgaggtcagccagtcaactggattctgggcgctgggaaagaagtggagtgggcgcgtaggaccctcctcccgagcaacgccaactcccaccacagctccctcccctcacctcgatctcgcggatgttgttggaggtgacaaaaatgccaatgccgatgggaatgaagatgagaccgatgatgaagaaaataggtagcaccgtgccagccgtaaggatgggctgccaagctggcagccgttgctgtttgaaggccgtgttatccggtctccgagtcttcgcggtgccccccggagcacacgggggcccaccgtccacttcatccttcgcgttatagttcatcgccatcgatccctggggcgccgctccgcgatttgcaggtggaccacccagggggcccgccggctgaccctgacaggaaccgctcgagcgccgctgccgccgccgccgccgcagccaccagcgccaccgccacagccacctccgctgtagagcggaagaggcgggacactcttccgccaaaggctgctgacgggaagcgaaagtcggctggagacgccagagggagggagagagggaggagggagaagaaggagggacatggggaggggaaaggggaggaggatagaagcgggaacgaaaaggcggacgcaccctgatcatctgtcctgtgacgggctcagccattggatcgcgaatctgcgttcgcgcatgcgtggtcctagagctacggtgacacttcgcgtgcggtgtaggcgcatcttcgctctgttggccgtggctttagtaagcacacacctgcctgctactctggttatcgtggcgacggcaggtctggattgccagacaggtttttctttttacctcgaggctttctctgaagggagtcggagcatttaaaaggcggcctcaaggtggattgagtcgggggaggattagcagtatttgcttaggttgtaaaaccgcgactttatctaataaatcgccattcaaggtgcaaatacaaacttggaacagaggtgcgtgacatgtaccccttttgtcctaaagtcaagaatcaataatgtgacttagccctattatcttgcctctaattaagcgattctcacttattctttctctattgctaattctcacgttacatttccccttttctgtgtccacctttctcttttgcgcattgatataggaagtgttttgtaataggctgtagctttttctcttactgttataaaaaccaggacatatagcattactacaaaatgagatactccgtaaacactttaaaagtgccagctatttaatgacccaagaaaatactcgtgatataaaagttgactaagtcaggatattagagtagtgtagcgactatagaagtacaatatagagcgcaactaaaaagtgaaaatggtaactctgctgaccggatgaaggatttttttttctgtttctttgcacttttctgtattttccaaaatttctataataggcgttatgttatttgtaaaatttaaacaatatatacaatccatattatactgacatctttgaaatccaggccagagagtaaatcatatcatttgaaaacaaattacttttttttaggcttagtctgcagtaatgccttaaagaaggtaaactgaggaaagagaaaataaagagtgcttggtcctcataatttaccgttaagctgggctctgtggctcacgcctgtaatcccaacactttgggaggccgaggcgggtggatcacctgaggtcaggagttcgagaccagcctggccaacatgatgaaatcccgtctttaccaaaactacaaaattagctgggcgtggtggccgcgcctgtaatcccagctactcgggaggctgaggcaggagaatcacttgaacccgggaggcggaggttgcagtgagccaagatccgccattgcactccagcctgggcaacaagaacgaaactccatctcaaaaaaaaaaaaaaaaattttacagttaaatgttttttttcaaaatgaccacaagtttcaaaaatgtgagccaatcacatgtttactaggcagagtttagagtgatataatacttgctgccttctaataaccgacttgcttgggtttgctcttacatgacattcatgctcaaattcttagcactactgacatacttaggtctatattttgttttgatctgttaagtttaccttcaaccccaggctcaaatggaaaacaatctatcacagttaatggagaaggctttgagtccttttattttgctaagttctgttagtaaaaatgtatgccacaatatgggcatattgcgaaagtacatataaggcaggtttttcctccccatttctgcctatatcatcatgcccactaaatttgataattatttaactgatctgctattccagcactctgtatatatggtcattttaccttcaattttttgtttttgttctagtgatctgagtgattgtgatgtatttatctgcttcctttttctttatttttgtttgttcataggaaaatgagttaatcccttgtctctttttttattagaaattcgattttgactgaaacatttacagaattgaaacctcctgagattcttctctaaaacttaacattttcagatgaggtccacatggatgaaattgcttttccagatctcttgatatccctccatttcattttccactactgtattcttccacaatatgcatctttacccagctgaaacatttttttcagtgtcacattattatcccagggaactcaaaattttgtgatgttcttggttacattattttatgaagtccttactaggtggtttttcatttaatctgctgaagtaggaattttcaaaagaaagcgtcattcagcatttctagggcaactaaagagaatagttctcacagtggactaccatttatgcattttcaaactgattgctaggagcgactggtgtgtgtttgtgtgtatgtatgttgatacatttagattacatttatattgttcaaatgattgttcatgtgctgattcttggtaaaagtggaatttatgtggctaaatgacatttattaatgctatcagattaacattctaagtatgcagtcaatgcacaagccccagtataaaagtgaatctaaaatgatagaacagatgcaagcccaacaatctgaaaaggtgtgtatatttagcctttggttgggaagttttatacaattttcattttttagttcagttgctgtgttgtgccactgaattcggtaaccagaaacatctaagaaaaaaatacagaagagtaactattgggtatccctgggaacaaggaagagaaaactgcaactggtcttttcattgcctaaccaaagtagatttgccacacaaatttgcttgttgggttccttttatgttgggtgctgctgtaggtctctagcttctaaccatattcaaaccatttcattcacatctgtaacaaggatattttaaaaagttgaagagggctgagagatgtgccatagtttttaccatcatgagtttcagagaaagttcttagtgactggaaatggtttgaattattttcagtgactgggtcatatttttgcaggaacaacaacaacaaaaataccttttccttttcagttgaccatggcagcttggtggaactgcaaaatgttcatttttaattatctcagaggacttttaggagaaagagtgatgtagaaattgtataataaacttcatttcctgtatttattgcatcagatattgattcaaactggcttttaaaaattactttttaaaattgaatttttcctgatttttgtgtagtgtacttattgaatactttcagttagatatttaggaaaatccctttgttctcacattgacagattgactgattagcctgaggtcataggtgttgtgatagaaaatcttgcaagttcttgaatagccagtcagtcatcagaaatacaagtcaagcaagatattttaatggttagcgtcattagaggaaagagcaattacaccaaaattctttagtagacagcctaagaactttgttgttgatggaaataaggcttcatttctcataattccatactttttggttttggttttttgtttttttgagacgctgtctcactctatcacccaggtgggagtgcagtggctcactgcaacctccacctcccaggctcaagcgattctccaacctcagcctcccaagtacgtgggaccacaggtgcgtgccaccacagccaattaattttttgtatttttgatagagacagggttttgccatgttgcccaggctggtctcgaactcctgagctcaggcacttggcttcccaaagtgctgggattacaggcgtgcctggccaattccatactttaaatgaaagaatgtgattctcacaagacttcggacttcatgacttccactgcatagaatctctcagttgattatatccccatggcatgtattttttcattaggtgccatcaattatagataaggtctttttttcagatatgatgttgccatctctaggataacagccaactgacatgttacatgtataacagttaatttctttaaaaaggggaacagaggaggaaacagagaatcgtcaaggatacaggaaagtagatattttaaatacgttaatttttttttttttttttttttttttttttggagacggagtcttgctctgtcgcccaggttggagtgtagtggcgtgatctcagctcattgctatctccgcctcccgggttcaagcaattcttctgcgtcagcctcccgagtagctgggattacaggtgcccaccaccatgcctggctaatttttgtatttttagtagagacagggtttcaccatgttggccaggctggtctcaaacccctgacctcaggtgatctgcctgcctcagcctcccaaagtgctgggattacagacgtgagccactacacccagcctaaaaacgttaattctttataaattatacgtttggaccatttttagacttgttttaaatttatacttttctatttttccaagttttagaaagccagcatgagggggagttcatttcatcatttttttttaacacttgaatcacttgagtcattaaaataactccaacatattcatgaaggatcttcacaaaatggacttaaatgtgaaagttagcttttgttgagcctcagaaatcaaatacattgggccaggcatggtggcttacgccagtaatcccagcattttgggaggctgaggcaggcagatcacgaggtcaggagatcgaggccatcctggctcaaatggtgaaaccccgtctctactaaaaatacaaaaaattatctgggcatggtggcatgtggctgtagtcccagctactcaggaggccgaggcaggagaatcgtttgaacccaggaggcggaggttgcagtgagtcgagatccccccactgcactccgacctgggcgacaaagcgagactgtctcaaaaaaaaagaaagaaagaaatcaagcacatttgcagtcaatagcactaaatatttatgacaacaaaggcaaagaccaagggcttccctctgaccagcacaccataaggcacaagataagttcaacaaactgtttcacaacatcatctatattgtcactgaatcttctgggaggagaaatctgcactcgctgtctttgcttccttaacccagtcactcagtaacccactgctccctgacttcacaccccacctccactctaactgctttgctagttaatccccactcatccttcaagattcaggtcagtagccaattcgaggaatacttgtttgacccctttggtggagttaagagctactttcagagctcgaggtaatgtatatatgacgtctgtccttgcacttactgtgtagtattgaaaaatatgtttatatctgtctttgttactagatgtaaatgaattcctcaaggtcagagactgtttttattcatttctacatctccaacacctggcaaagtgcctcggccataaaaggtacttgataaatcttgttgaactgacctgacctactctcagtgaacccacattttagtgggagagacaccttgctgacaactgaaatattatgtaatgaagtcagtgccacacaagatatgtgttcaaggggttataggagctctgaggaggtaccacatgtcatccgccttatgatgtcaaaaactaaactgtgaggaaattggaaataaggtcagagttacattgtggttctccatgtaggaaaatagagaaaagagagtcttatgctaatattacatgtactataaatgctaagcaagactgtgtactctgggtgatcatgttcttttcctcaagcatgatctcatcagattgtggtaaccatggaaacagacatctctggtgccctccatttctgggagataatcagtttgttgtctcactgccgacttgtgtcagtgctccacgtgggcgccaatacatgcccctttgtgatgcaaaaatgagcacatttctctcaataaagcagtataaaccatcttgaggcctgatgaaactcctttctttttaaaggcataccttcccttagaatcagtgattactaaaggtcttttcttatttaatccagataatctgcctctgaaaccttccgtgggcacagaaatttctgcaaggaaagcatcagcaaccagaataatttggtgaggaagatttggcacagaataccctgactgaggtattgctccaaaaggagcaatcctctggggttaggagtcaattattaggtgcctacaaaacactctgttatttcgactaaacatgccttgctgtcaaggagaagaaagaactgtgcactgaaaaccagaacagccaaaaaagaatgtggctgtggtcatgggaaaggtctttgaataacagggaaaaggagacagggcagttgaaggaaggataagaaaaggctacttcctagcaggaattaataaactaatgtttttattatttaatagaaacccattcctttctttcaaataaggcagagataagttaggattggatgtagctatatagatccctatttctggcacaggctgatagcaataaaggaagtcagaacacaaccccactctcacccacatcccactttgcaaaaaccatgacccaaatgcctctgtagatactgggctgtggactgctggcaaagcctcaggagcctttgctctactgagtgatctacctttagattgacagcagcggctgtggagtaacatctgaatgttgattgacagtgcagtttgtgggaataaagcagggagggaaaccctttaaccagtttccatttcttggtgtcttaaagttttcatcttactaaagaatcaaaccgttgtgtaatccagaggaagagcatccctcatcctggcagccctgctctaccacatctgcctatccatagtgaaagacaccatatttttaagaaaatatgaaatgcagagatgaaaactattttggagcaaatgattttaaataaaaaggttgcatactcattttaaatgattttaattttctgaatattatgttccaactcaagatattgcacaatgctttaatattacacttgttatttttctcacactagtgagattttgataaacatagttgactttggaagtaacagagaatgttttcattggttaaataatttcaatgacctgtgaggaactgaaagcaagctattacattcatataaaagataagtacatatccataaattcacttggattcaatgaaaaataataaacttctcgtgtacttaataaaacttaaaaggaaacaaaattttaaatggtgcaaaaatagaatgtatttcttaaagttttgaaaacacttagacctaaaagaattctaagaatatctggccacattataagcctcttatttgtaaaagctaacacttgataattttaaaacaaaatctagattaaataaatatagttctgcattattaaagtaacaaaatctgtgatggtaaggtaaaatttccctaaataatataaacaaaaaacaacaccggaaagcaaatgtatcacgttatggcatcgataaacatttctgttcaaatgtgtggatctacagcattttctctaggtaacacacacagttgttatcacattagtatggaataaatgctgaaaaattaagaaatactaatggttactaggccaaagtcaattccaaaaaactcaattcttataaacttttattatagtgatttttactgtattacaacactttttttctctttttcctttgctttgtgattcatatttttagcagaggcatagcactggagataaagaaggggaaatatgcttcaggtgccagttgcgttttttaacttccattttgcacttttgctatttttagacttgttgctcatcagattcattaacacaccctacttttgctatgtttttttccttcatttccaggaaaactcaaccacagcattaggagaaaaggcaaaaacttcacattgcctgatacaccacttattcttgctctgccactgatttgtagtagctgtgtattactgcagtagcgctgttgtctctattaatgcttagagattccacaccatgaatttttttatggtcatcctaagatacaatgaattcttcacattttgtgaaaattataggcatctgacagctggtgtatttatctaccatcttcatcaaactcgaatattttataaaatacttgagaaaagatctctaccaaagataccctcatgaaacactctcttatcaaaaagaaaagggtaaaattatggattagttcaattgtaccttgaactagaaacactgattatgattatatttcagaaaacagttataattatttcattaaaaatgattcccatttagaatgatgactggagacttatttacaagaaaagatagagaaattttatgagcctaggattgtgccaggattgcctgtgagggcagttttttcaattgcatatgcatgttgagatgggactatttatgatcttatttccttattcattagagaaggagatgaccagtgttttctgggggttttttggttaattttgcatattctcttatttcaaaattaatctaattaattttattcatgtgtcactcagattgcatttgggtttaaacagaggacttaatcatagcatggacagaaaaggctcaccatctatctaaatgactctgattgcaccatcatcctcattgttcttgtaagttccaaattcattataaatctggggaaaaaaaatcttcaaatccaaatatacatacatttcttatagtattttaatttaaatcaagaagtatttaaaatcttatcctctaacattttcactattagtataataaaattcccacaagttgagaaagttatttgcttcaaatactaatctaatatatcaaataattttgccatcagaggtacaaacattggcaaataggatacttaactgtgagtcaaaaaatataacagtactaactaaaacacttttctaattgaaaatgtcattacagtcaacattttcagaaaacaaaacccagtaacaattctaaaaaatcacacatacacactccagttttcttagtaaccaaaattctggaagtttatgtgatgttttcacaatcattcaagctatggcaagcctactgtaacatttcttttactttaaaaaattaaaaataattttaacatcatataatttataatacatgttgaaaatgatttgccaattccccaaggtgtaacttaaaaccttccaaggttacataggggaggaagtccatcattaatttttctattccagagactcagtttggatgcccgtgtgtgggcttctaaagctgagcacaacctgtgaactagagaaatgggccagcagtcctccttgtgtggcttttagttatccttgtgacactcagaagcattctctctttaatttcagtaaagttacatgataaatgacttccacattcagaaactgatgtgtcaactcttaatttatctttaaagttatctttaaagaccttactaaaaacatgtccatattaacagtctttaaaaaaaagagtatattaccagggtttcaagtagactttagatgcacattttcacataaacctaaattcaacagtagctctgacgttgagatttgagtaatgcacgttgtgctttttatcttcaaagaatatattctctgacctacctgtagttacgaaaatctttcaaaatcaaggggaaaaaagttatcgatcctgagatttcttgtactactttttccttctgggttttgggggtttttgtgtgtgtgtgggtttgtctttgttttgagacagagtctcactctgtcacccaggctggagtacagtgacacaatcatggctccctgcagcctccatctcctgggctcaagtgatcctcccacctcagactcccaagtagctaggactacaggcacgtgcaatcaggcccagctaacttctttttttttttttttttttttttttttttaagactctcactgtgttgcccaggctgatcctgaactcctgggcttaagcgattctcccgccttggcctcccaaagtgctgggattacaggcacgacccaccatgcccagtcttattttttaaaaaagatcctgacattttaggtctgtttttatattcaagttttgattggattagattgtgagaactatctttatttcacagtccttattataagtcttatacatacaagtaaataatgcaatcagaagtataattgaactgtcagtcgaagctgttcttattgcccttactggttaaactggtacatctccttttatgaatttgttctatataaaaatcatttcatccaaggtttttggcccagaacaccagaaagagcaactttagaaactgatttttagtatttaaaattaagcttttaagtcagagcattatttgttagcattgaaccatgatcagaaccatagcattgtacaagcaatagtaaaacctcttccagagtctcctgcttctaagttttacctcttgaatttacctcaggaaatatagttgtactttctttttttcagaattaacaaattgataaaaagaaaataattatagattaccattttgaatgcaacaataccagtactttgaagaactgacagcgtattccatagatatatgtgccagagactatgaaaaagggaaacactttagcaaaaaaaatcacattacaaaatgtattataaaatataagttatacagcatgtgcccatagacctgaaagctttgcaaaaagaaatttcttttggcacatagattgaattgctcttgctacatattttcatattatcagcaaggccattttcagctttttacattatatccttaaaaaaaaatcactggaagtagtaaaatatttccagtagtgatcagtagcatggaggaccttagtcatgattgagggctgtccattcaatagggattcagaggtcgtacacacacccagtatgtgcttggtttaccatttcatctggagttcattcgtaactggtgaatgatgatgctttctataaagagaaaaaagacatggcattttcaattaaactgaaactgagaatcaagctacatcatttcactaaaagatcatagatgttaaataacaaaacaaacaaaaacaggtacatgaggctaatagactttcctgcattactattcttgggcaacgtctttatattggcgtatgtactttacctcgaaatttcttaaagccctttagaaactacgtctaacgttctgacaatagtagatcagttttgaccaaggtaagaactgaaaacaaagatagtaattactatatacaaaccccttaatgagaaaccagactatttcctagaagtaactctaatcttccagccaaattttctggtctgaacaatatttacacctcttcaatttctttgtgtgtgtgtgtgtgtgtgtgtgtgtgtgtgtgtgtgtgtggattagagtttaataaggagatattatttctaagtccataaatataggtgactcacttttatctctgcgtctttttgcataactctatatgtttattattattattattattattattattattattattattttaggtggagtctcgctctgtcgcccaggctggggtggagtgacgcgatctcggctcaccgcaagctccgcctcccgggttcacgccattctcctgtctcagcctccccagtagctgggactacaggcgtccaccaccacgcccggctaattttttgtacttttagtagagacgggtttcaccgtgtcagccaggatggtctcgatctcctgacctcgtgatctgcccgcctcagcctccctatatgttttaaaatataaatttattcttataaaaataaatttaaactagattgaggtagtaattacaacagtccagcacattatggataattaatatttatatttatttggctggtttttcttttatagtaaactttatgccttaatgaacatttatcagtatgactcacttcattcagtcattgaataactatttattgaggctgtatactgtgctaggtaggcatggaactacatgcatgatcaaaatgagacagattcctaacatcactgagattatacacagcaggggaaagaaaatattcaaacttcaaatagtttcttcatccaaaaaatttattattagtacctccttgtcaacatatggtatatgttgtgagtgcagaaacttagggtttatcaataacatgaagaaatttctacctattattttcacatccatcccaaatacctagtatttaagttttatttttacttatgtagttagtatataagtaaacattaattaaatcgtattatgccatagacttataggttcatagtaattacacacagtgcatgattacctgccaaaaagaaaatgttttcttaatttggtgtcgttaactttacctcatgatgaccaataggtggagctatttccattttttccctcagccttttggcttgaatttgaggtagataagaaagccaagtaagatgaactatagaatgtcttatatacctaagaatatttagctatgaaggttttctgaagctcttaagacatacatactatattgtactataccagaagcccttataaaccatctcgtttttttcattgaaaaaatattccagcttcaacttcaaatgcctaaaaatatatcaaaatcttcaggcaaacaattttaagtactaattaatatcatgtagttaaaaattagcatccaaaattaaaatgatgtttctcactaatttaaaaaaaaattctgcagtagattccaaagagtaaaaagacccaagtctcaaatctccctggtaaaattaaagttatctccaatttccttcccttaagaaagcatagataaagagtgaaatcagaattgttcttattgtggatgtaattcagaaatcttctgcctttgtttccacagtacaaaataagggtattagagagcatctcaaaaatccctttcagggttaacattttgtattactacaataccttctttctccttcagtgtgcagcagtggaaatttacaaaatgctaggattaaggcaatttagagttgccttgtcttaatcctagcattttgcacaacttagagttgccttgtcttaatcctagcattttgcacaacttaagagttgccttgtcttaatcctagcatttcaaaatctccatcatagtaataagggtccgtacacagaagaaacaatgtcttggttggaccataacatttaattactgtatttaaattagcaaactcataatccatgcatcctatgtatgctaatgctattaatcaaatgtgttattaaaacaaatgtctcagaaatacttgataatgctaaataagagtttatcttatataaattgtactttaataaagggtggtatttaatacttatgtacataaactttatttaaaagaatacaattaagcccaaattatgttgttttatatggagaccaacttcattttatttctagagatagtgagataaaatctgtatgatactggctctattaattgaaacttattaaacagatttactaaatctatagttgcttattagctatgttttccccaagtctctgctgaacttactcaataagaatcacctagccaatgcacaaaattgtgataaatttttaaaatattgctttaaagccaggcttggtggctcacacctgtaatcccagcactttgggatgatgagaggggtggatcacttgaggtcaggagttcaagaccagtctggccaacatggtgaaaccccatctctactaaaaatacaagaaataagctgggcgtggtggtgtgcacctgtaatcccagttactctggaggctgaggtgggagaatagcttgaatccaggaggcggaagttgcagcgtgccgagatagcaccactgcactccagcctaggcaacagagagagactcagtctcaaaaaaaaatattgctttaagccattacattttgaagtaactcattatacagcaaaactgtctgaggcacatggagtccatgttgccagcaaaaaaaaaaattaaataaatttttaaaaattagtgctttggggattaatgccattatttgtgtaaaaaaaaaaacagacttgaattcccaagtctgttcctgtctttttgtatatagtacaataaaataatgttataaatcttattgaagttacagattcagtgagcaaattttattccatctcctactgtcttcatttcatcccagaacaagattcaactataggtcatttggggcctctaaaataaccccagtaaaatcaggtataatttttcataacttttcttcttacagatcataattttgcacaactatcataatttttcttcttacagataccactcttctgacaatagtgatttggagagcacttaataggcagattggaaccaaagaccatagataattaccacctctgtcagcaaactcaaaatagcaaagcacttaaatttgggaccctctgatatgaagatgtttattaacataatttcctttttttctaattggaagttttaaaaaccctaaatttcaatgaacatatacatatgagacactgagtttttatatatttttgacattagtggctttatcaaagtgtacttagagacaatttcccctatatgtttctctccagtgttaccttgacgtttttttccttaaaaaaacttcaggtaacacattaaatgcattatttgttattatgacattattgtgaaatgatgtagtttttatgaagtcttttagtacactagctattggataacttcctggaaaggaagttcaacatattgtcaattcctaattaaacttgatttctgaccttactaaatattcatcctccttgggtggtatcccaaaactactagccagtcatatgacttgagatccaaagctgtgtgcatgagataggatttggggagaaatttgggggagaatgtttcctgagtgcagagtgaggcaacctcacaacaaattagaattctgtttcctcccaggaggtctccttggctgtagagtgagaaagatgtactccctaaaaagccaatacctccctcccaagtaattcatgtttatactctgccaaacactgcaaaggaacacttgagctctacatttaaaaaaaaaacattcttctctagcaaataaggccacatcactttaatagctagcctctaagttcacatactaaagacaaaacataccagaaattcaacttataacaagacgttacatcagcaaaggaggattgctttatccacaggaagctgtacaccaagttacagaacaaaaacatgtcctcttggattttgcatcaatttgcctatatataacctgcttcccatgttctatggctccctacccaccaggggctctgcctagaggtaccagcttagggttgtgctattcttcccctcccccgaccaagtaccaaatatcagctttgaacctactggcctcagaacaacttgtccactgcaaaaatgtcctacattctatttaccttttagaagtacttagatatgatttactttcaagtttctcattttcctaaactgcttcagggttcaatcctgttattatcacattcagaaattaatcacagttctgttaaaacatctgttttaaataggaagttcaagaaacttcctctcttgatttggacttgtattcctcttttggattcagcttagctaattaaaaatacttccgctaataggttctgtcatttgctctaggaaatttttgaaccagatgatacaaactctcttgggagttctcaaccacctaataatttatttgcttccttccagcagatttcccactctaccatcagcccaaattatctccttacctccccaggatgcagaagtcaccaataatcacagttataactgataaattcttttttggcaagctaattcttatctccagcatagattgctgttttacagatacaagcaaatttgaattagttcccatatataacattaactataaataaaaattaagtaatggaaaaataggtaagtatttgagcaaagcatgctgaggttctactcttttaaacacagatggtaaatacctaggttgttctaagtctatggctagtcacagaatagcatgcaaaataacattatgtgtgaaaactaaggtcactgcgctttttaaatgaggacaacaatattcatcaaaatattgttgtaagaactttttcacagtttctatatagatgtcttagtagctcaaaatcatttagcagtattattttgatccaatgagtatgagtgtttcagtctatgtatgaatgtacattttactcacttgtagtagtttcatcatatgaaataatgaataatgtactgggagaaactgaagaactgatttttggtcctggccttatcattaataagatgcttagacatctgtacgcctcagggattttttttaaagggtttgttgctgtttgtcttctttagtaatagtaattatcctcttgatctctaaggtctatttcagttctaaccagctctgtgattttgcatatatgtagcattagcagaagtagagaggccaaaagtacttttaccaggtaagtaattaatcattagatcttaggaaaagcattgtagcaggatcttgcaaggtgcttgctaaacaatagtgaagcatattatattatgactctaagagagaatgccagaatcataaaaaattatagctcagtgctaaatcataggccaaggtagggtgatatgccaaaggttacacaaccttttggtggtagaaaagagtatggctccagtctcatggttttcagttctctcaggtatcaagtccatttttcagcagcccttcttctctggatattcaccctgatatctatcctaaatctaaatcctgctttttggtggtgtttggtcctttaaaatgagagcctctctgtcctattttgagggtccttcatgaacttgaagagcatgagacaaacccctgaaactttctcattcttgaagtgcctttgtgttctgctgggggagtcggaaagggtgaggaaagggccatttgtaactcatgcatgtactgtgtgtttatacttcacagaaagctctcaggcccctttcttcacaggcctggtggcttctgaggtgagaactccccagtccaggactcctggctgttttgcatccatcacctgctgttgtgcctttggagggaaatagaagtaactttcaccacccaaaaatgacagtacctggacttcctgtaattctgccatctcattacctgtgtgttctcacacaggacttgttagttccttccacgtcattctcactggtttgtgttgcaaagagaggaatcagaaacagctctttcttgcccaactttctgccatttttcagcttctagttttgtttatctatagtgagtgccaagctttgtacagcagtggacaggcctttaaaccccagggtagattctgaaataatagtttatcttcctagaagaggcaatgttcataaaatagactttgatcagagaaggacacatccgccaaaagaaaaataggagaaagggcaatacaaggagaaggaacaaattgagcaagtcaaggaagggtggcatggcctgacagtcaagcaattatttaagcctggagtgtgggggtcccgccaagggaagggaaagatgctcagaagaatggagaagtagagcccagtcacagagtgcctcaagtacatagcattgtgttctatgagtaataaggaacttttgggcggttttcaaatagagatgatgatatgatatgatatgacatgatatgatatgatatgatatgatatgatatgatatgatgtatgatatgatcaacttgcattttggaaaactgcaagaatgaaaaatgaatcctagagttttgaggctggagattacaagaccaattaggagggtatcagagtaacccaaatgaaaagtagttaaaaccctcaatttaggccatggtaggggaaatggagaggaggagtcagctgctagagatgttagtgggttagaatgagagaataagcaggacttgctgaatgagggcagaaggagaaggagaagcatagatggttaccaggtttctagcttgggagactgaatgggttagatatccctgttgagatggagaataataagagaaggagaagctttggaagaagatggggcagtattgaaaatggtttttagacaagctgatttggaaaaacacactataaagatggatacacagttggtgatagaagtttgggagtcattggcatctgggtgtagatgaaataaccagagccagcttgtagagcaggaacatggctcttaatagagatgtgggaaacatcaatccttattgtgtatacataaaataaggagccaacaagggaaactgaagcagagcaaagaggtgaaagaagcagcaaagcagattagatatcttggtcattgagggaaaagagcacagcctaactctgcccttgcccttactagagaccagaggtttgttttctggaaaaactgacctaagaagttctggacccagacataagaatgggcagcagactgattgcaggggagtaaaaactttataccttgagctgtgagattctcatcttacctcccctgaccagaatttggatagcctgccccagaaaggttactggaggactttttcctttaaaaactattagaagatgtaaagagaaagagggagagagagagagagagagaaagagagagagaggatagatagatagatagataaagacagatagatgataggcagatcaatagatagatcaatagataaaagaagtagaatataaccaatcagggaaacagagaactcaacataggcaaaagggcaacagctgtgcagcaggcctagaaaacaaccagtccagactgaatatggaagcagagggctgaactaggaaggcctccagggaaaaatatgaaactggtgtgtttaagtgtttggaaaaattactgataggtgtttggcaagtctaatggagcatttggaaaaatatatatatagatatatggaaaaccaagcagatgaaaaattaaaacaattattcttttgaagggggaaatgtggtaagaggaagagagcataatcatagtatactacttggctcagctgatagtaatatttattatttatttatttttatttatttattttgagacagggtcttactttgtcacccaggttggagtgcagtggcactatctctcactgtgacctctgcctctcaggctcaagcaatcctcccatctcagcttcccgagtagctgggattaaagggatgcaccaccatgcccagctaattttttgtatttttgaggctgcagtctaggttttgccatgtcatccaggctggtctcaaactcctgagctctagtcattcacctgcctcagcctcccagagtgctgggattataggcgtgagctaccatgcctggccagataactatatttaaatttgcactgcaaaacacataaatatataaatgttggctgctgatttatcaaaaagttgaggatgtaatcatattgggaaaatgagaaaaaggaaagagaagggataagtgagaaggttaaaccttcaaccatcaaaacaataatgcgaagacaaaagagatctaaaatctagaaatagaaagtcacactataagcactttagttagaaatatggagataaatgccagaagaaagagctaagagttggaagtgatgttctccgggggaaaaaactgtgggctcagggaagtggtaaggaacatctgttttcattgtcttttagctctggctgatatttgaactatgtatatgaatttctttattaaaaataaaaagtgactaatgataaataagtgtgagactggaggcaggaattctctcaatagctcacctgggcatggaaggagactgggcagtagctacagaggactgcatagatgaaggaggaattttgctaaaatgagagaggtcagaggatagcaagtgaaaacgagaagtggaaagaccagagaacaaagaaataaccaatgatgagaccctaaagagacagaaaggaaacattatccaggttgggaaaatttgggaatcatatcttcctgtttcctgggaaatcctctctatgctcatctcctcattactcgttctctctctcagccctccagcctccaatataaatgtgctcttcatatctataaccccatgtttttcccaacaaggaaagtctcaccctttcctcaatattctgaatctggggaatgagaaatttaaatatttttacacttgatattcttagacttgttttcatgtctccgaaattatactcttcccacactacacatgaaagctatttttcacttctttcttgaagacattcgagtaagagctctgggtacacccttaacgaataccctaaaatctctagagagagctcaattgccacccatcaaccagtcctcactggaaatacaattaaaacaccagtagaaactgaatagcttttaagcagatgacctagatatatagctcacatgtaaaaaaatgataaacactcttgaggctgtgtcccatatcgaaacatttctggaatcatgcatgtaagctggacaccaccatagtgtgctgaaatagtcagcacattataattattctcaggcagtgaagaccagggtctcctctgtagctgtgtagatcgtgtcctgcacatccctagagggcaccaacacactgaagtctgtggaaatggcccacccttcccaccccaaagtcacccaccgtcccaagatttcagggtggggcctgagcagcagctgtacacatcagccatagtgagaccccttttattttactacgcagtacgtttcaggacagagaaaatattgcaaagttttcatcccattcacccctacaaaaagcacattaagttgcatcttaaaagtactgtcttcacaaatggaagttggatttgtggtacatttagttcaccacctcctatccccagtggattttatttctaatgtgtggcttaaagcaaagctatccaataaatatagagtgggctctaaaattacaaagaaaaactgtcatggtagttgttctttatcatttctgaaaagcaaatctgtgttgttctgccaagttttttttagcagttgtactttgtgggtggctctattccaatatctagatgtataaacatcctgtacacgcactgttaagccttcagagcactctcctgtagatggtatagacttcctggaagaaacaccataagcatgatgtgagaaggtaaaagcaaaagcagcagcaagcggcaataagattatgataaaaatcactgaagaatggcaggtggagtcaaaaggaatgcggtgtttggttcttctgacaccctcattcgctcaaatacaatacgttatggtacagtaacactaaatacttcacaaatgtcaggtacacattagtaaaaacagtgaatgtcttcatttttgaaagcgttgaatgttcactttatgaaagaggaaaaatcttgtaaaaaaatatgtcagtattccaaatggcaatctctcttgttcaaatttacccaaaatcataaaatgttctttctcagtctctccctctcctttgaccttgaaatcccattactatggcaggtctttaacatggctcctcaattttcttttttttccttttttattttttgagacagagtctctctctgtcgcccaggctggagtgcagtggcatgatcttggctcactgcaacctctgcctcccaggctggagtgcagtggcatgatcttggctcactgcaacctctgcctcccaggatcaagtgattctcctgcctcagcctcctgagtagctgagattataggcgcccacccccacactcggctaatttttgtatttttagtagagatggggtttcaccctgttggccaggctggtctcgaactcctggcctcaagtgatc

SEQ ID NO: 853 - DNA, 625 bp, Homo sapiens
  misc_feature 151, 397, 463, 495, 537, 584: n = A,T,C or G
catccattttattttattttgtcatgtgctcaacagcatctctctctctctcccctctccctggcaggtcacagagataaattaaaaataaaatctacaaggaaaataatttataaaagcactcccaggttcacaccttctatccctactngctcagttaggcaccccctaactgggaatcagtgcttccccccacccccatttcactcccacttgtctggggcagacggtactccagagccgggcaggggtgagggcagcagtggcaaacagttaaaaataaagacattgtagtcctggaaccatctggccaccttggcactcccatgtctgcctcccccaggcagccctccaggagcctgtgcgaactggggggctgtggagaagctgcctgtgntggagagcttgtgtgtttggggaggtgctctcagcctgtcatatgcacttctcaatcttctagaangaaacccaaaaagaaagcagacgacgacctcnggacagaggagaaaatcccaagtgttcacacagttacacggngtcttttatgggcaaagagaacatttagccagcttgaatattggggnatctcctttttactcaaaacaagcatctagaccctataagt

SEQ ID NO: 854 - DNA, 850 bp, Homo sapiens
  misc_feature 8, 13, 14, 19, 31, 33, 37, 68, 114, 221, 364, 367, 369, 372,386, 425, 430, 441, 465, 500, 602: n = A,T,C or G
tcttaatnyttgnnytttntgcccccccctntnggtnttctttctttttcatttagatatcgtggganaaagtggagaggacatctccattttcccatacaaactgagggtganaagagaaagagaagcaagctgttgcccccactttggcctggcttcccagccatcttcccagccctggttctttcataggaactagttattgcttccacaatgccgtnatacggaatgttccacaaaggctgttaacctagtcacagtctacccacaacaagaactctgctcttaaaaaccagcccaagagctcttacccagaagaacaatctttagccctcaaggtcactgaaacttcattagagcagtntanantanacgtgtaagatttngcatatattawwtkattattggcacaatgttctccagtnccatntataaattttnatatgcacatcggccagggcccangatgaatcagccaatctgcaccatttttatgtcancaataattccatctcttcccttttcagcactgtagggagagccgcttcatccggttctccaaggcctgtccctcaggggaggtgctgctttggctcttactnctgcsaccactgcsactgctactgctgaggccccggttgttgttggctttktcacttgttttattctctgsccctwctgccctgtctcckcgtkctacttcacattcagggggaggaggccccgctgcattcacttcgrgggsccaacactgggaacrtcatcccaaactctgacagggacacagggctgggcagagccaggctgccagsctcacaaccgcrggagactggtcrcgcatctcagacgg

SEQ ID NO: 855 - DNA, 667 bp, Homo sapiens
  misc_feature 470: n = A,T,C or G
gggacttttattttcttttagagagggaaaaagtgtcccagttctctcctacagaaaaaatactttcagtatgtttgataaaactgtgcttgtcatgagttagtcaatgtatcaggttttccaagacctttaccagtaaattatgtttctgtatgtaaaatagccccttattagagagacaggttatatgtatttacaaaattatataagttccatgggatgtattgatttgtattttcccaaaatagtacttgaatgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaancacatttcccttcctccctctaattctacccaaatgatctttattccttcctttcgcaattaaaaaaaaaaaaagggtacaaaaattctgtgatcttgtcctaaaatctatttttctcacctttctgagagaaagtttttcctaattatggtccaataaatttgggtcacatccagtgaatcccttctaaaaaaaag

SEQ ID NO: 856 - DNA, 2591 bp, Homo sapiens
ctcagactgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgttggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctggggatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaattctagaaagcttaaaaaaaaaaaaaaaaaaa

SEQ ID NO: 857 - DNA, 4760 bp, Homo sapiens
ggccggcggtggcggcggcgagggctggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggtggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagattcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcaaaaaaaaaaa

SEQ ID NO: 858 - DNA, 342 bp, Homo sapiens
catatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttatcggtaaagattgtataggcggatgcagtgatctagtctctttgcaacagagtggggaactgctgacgcggctaaagcagattggagctctgcagtaaccacagatctcataggaa

SEQ ID NO: 859 - DNA, 2059 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 860 - DNA, 7171 bp, Homo sapiens
cgggcatgctcagtgggccgggccggcaggtttgcgtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttggcaaccagatgtggatttacctgtcagtccatctgatggtgtcctacctaattcaactcatgaagatgggatttcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagctcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaaaaaaaa

SEQ ID NO: 861 - DNA, 1328 bp, Homo sapiens
ccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtaaccacagaacaggccccatgctgacgtccctcctcaagagctggatggcattgcaaatgatgacagcacttctggtggatgaatttgggggcacaaacagcttttttcctcttttggctcagtatttaaaagtggaccaacttgctcttaatcacagggcaagaaggttgaccgggccatcttggttttcttctggatgagctctttggttttcagaagactgtgacaagttctggcccaggattcgctcactgaccctcaattgtcctctttggcatgcgtttcttactgttctccatgtgtcggcatgtctctacctctaagccagtgtttttcaactatgtttatccagactccttctccacaatgatgaatccacagttggttatctgctactgcccattagctaaaatcattttgctgcttgactttatggagtttgtattatgaaatcagtggtattttgaatgtgttctttctaactacatgcatctctccactcaactccaccccatcccatcccaccttgaaaatcgctgctctgaaccagtgttctccaccttgtcctccacacatctcataggaaatgttcaacaattctgtgaaaggtcacaggacccaattggagaaatcatatgaaaagcatagttggtcttggtgtcatatggatcagaggcacaagtgcagaggctgtggtcatgcggaacactctgttatttaagatggctatccagataatcctgaacactgtgtatttattttatttagactaccagcaaagattaaagcatgaaatgtaaaacatctgataaaacttacagccccctacaccaagagtgtatctgtgaaagagctcctacactttgaaaacttaagaatcccttatcatgaagtttgcctgttctagaattgtaagattgttaatttccttcaatctctagtgacaacacttaatttcttttctaataaaaaaaacctatagatgattcagtg

SEQ ID NO: 862 - DNA, 4611 bp, Homo sapiens
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacatcttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctt

SEQ ID NO: 863 - DNA, 270 bp, Homo sapiens
  misc_feature 81, 100, 126, 129, 141, 142, 150, 175, 178, 181, 263, 268: n = A,T,C or G
aaaggcgcaaacaaagaaaaaataatgtatatttttaagtatttgtccttgaattgttagctccttgttaaacaaacaaanggagagaaaatcccgaggnaagttttcctgggatggagacaactnttnactatgtctgtnncccctccnttctgcctccctccctttccctttnttnccngtcctctatccttgctgcccctcccccaatatgtcccccaaacccgggggctcagtatttatttatttatataattgcaggngtgangg

SEQ ID NO: 864 - DNA, 568 bp, Homo sapiens
tttttttttttttttttgcacctattcaagtaatgtgttctttgcagcttgagaagcatcatacatattcacaccagtccttgagaaggaggtacgtccagcacacctccctctgtgaagggaaaggctcagagcatggtttgctattaagaaaattagcacgagcagtgaaaaaaaccctagaaaactgggcaacagacaaaatcctaattgtatttaccatatacatggccacaccctactatgctactgcaagatggtggccctcggccattcttctggctgccagcacagaccagagccctgggcctaggctctgtccctacctgcctccttggcagttacaccttggttctccatttgaaaactacaaactttagagcccaaaggaatgttagaaaccatttgcctcaatcccttcaatttatagcggaggtcaactggagatcataagcatgtaaggcaggggaaaaagaaacggaatgtcagtgagaatctgtggggacttctgtccatttcagaatggaaggtcttctgtgtttagttttgactctccctcgtgccgaat

SEQ ID NO: 865 - DNA, 733 bp, Homo sapiens
  misc_feature 697: n = A,T,C or G
tttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccggggcgctcccccatcccctactcccactggctcagcgcgggccagtgcaagggtggcacagaatgtcttgtcgcaccctggggacacttctgagtatgaagcngggatgctattaaaagctacatggggaaccggtgca

SEQ ID NO: 866 - DNA, 500 bp, Homo sapiens
  misc_feature 437: n = A,T,C or G
ggctgagacatttattatcaacattgaaggacaggtcgagtcattctgactcctctgaatttcaaccgactgatttgcggaaaaatatcctggcatggaaattgcggcagctggaggccgcgctccagggacccaccgcggggtgtcagcaggacagaagcactcccagcccatttctcacgcttctttagaaatgcaaaaaaagtcagacattttaaaaaaacagctgatctggacaaaaggcagacccaggctctaacccagctacagaaaggaagtggccgtgccactgagacaggcggtcacagacacacgcagattggtctgtccccagagggcgcttggagggcagcggaaggattcgggcctggataggggcttgacctagccctcctctcccttctctcctcctcctcgaagtgggcttgcttcttccngacgttccaatgcaggcactgggcgaggctctcaaaccagtcgctcacgggtcccgcacacag

SEQ ID NO: 867 - DNA, 498 bp, Homo sapiens
ggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctattttggaaatttgttcattaaaattctcccaataaagctttacagccttctgcaaa

SEQ ID NO: 868 - DNA, 608 bp, Homo sapiens
  misc_feature 221: n = A,T,C or G
tttttgttttaaatattctttagttttgttatatctgtgtttaatatatgtttatacccttctcacaattcatattatggacctgagacactgtatacgatgttcatccgtcatagggagatagtggaggctcaggagcaggtggcgtgcctggggctggatggagtctcaagacagcaggtgcagaggtggtgacgagtaaacaggccagcagagcctgngttaacagtctgggcctcaagacatgccccaggccaccaaaagtttagggtgagcgtactgcaccctaaaatcccaattctccttctgctcccataccttttcccagtcatggcccttgtggatagggcctatcagtctatagaatcctgattccatgttttcccttccagaacccctagggtacagtacaaatatagtccttctttcctgagggggctaggagagaaagacaatgaatggcaccctgcctgatcttcagggaaagctgaaatactggtccacagattggagccactgcccaatataacttctcaagtccctggctgaagacagacttgagggctggcatcacctacttccctagccccagtgtgatgtggcatagg

SEQ ID NO: 869 - DNA, 615 bp, Homo sapiens
  misc_feature 457, 526, 564, 569, 599, 608: n = A,T,C or G
taacttaagcaaaaaagggtatttattggttcacataactgaaaagtccaggggatattctagcttcaggcacggttggatccaggggcacaaacgctgtcatcaggattcaagtctctccatattttggctctgctttcccctgcactggcttcattctctacatggtaggccctgttagtttgaggttttcatcctacaaagctaaagcaccctcagtaaagagagcttctcctccacagttcagatggatttgctgattgatgaggtctgaattacatgttcacccacaaagctcaaggttgggtcagactgtccaaaccacagactgaaaataggaagaggtggttttaagaaacatcagggagttgttacaagatggaacggatgctgggcaattaaaaactactgatgtccaggataagaacagatatgaaaaagcttaatctctgcttangaagttgaatggtaacagctggcatggtttccttccctggttataaaagtattctaaaaaacaccatgngagataagtttgtcctgtcctcaagaatctgtaatccntttgnatggaataatatcctgtcccatagctatgntggatggancccagtt

SEQ ID NO: 870 - DNA, 3504 bp, Homo sapiens
gagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccc

SEQ ID NO: 871 - DNA, 109575 bp, Homo sapiens
gatcctgagataactggctagccatatgcaaaagactgaaactggacccccctccttaaaccgtatacaaaaatcaactcaaaatgaattaaagacttaaatgtaaaacctaaaactataaaaaccctagaagataacctagaaaacaccattctggatataggacctggcgaagatttcatgatgaaggcaacaaaagcaattgtaacagaaattaaaattggcaaataggttctaattaaactaaagagcttctgaacagcaaaataaactttcaacagagtgaacagacaacctacaaaatgggagaaaatttctgcaaactatgcatccaagaaagatctaatattcagaatctgtaaggaacttaaacaaattaacaagtaaaaagcaaacgacctcattaaaaatggggaaaggacatgaacagacacttctcaaaagaagacatacacatggtcaataagcatgtgaaaaaaatactcaacatcactaaccattagaaaaatgcaaatcaaaaccacaatgagatactatctcataccagtcagaatggctattattagaaaatcaaaaataacagatgctggcgaggttgcagagaaatgggattacttatacactgctggtgggaatgtaaattagttcaatcatggtggaaagccatgtgtcgatttctcaaagaacttaaaagagaattactgttcaacctagcagtcccattattgagtatatacccaaaggcacagaaattgttctaccataaagacacatgcatgtgttgtgttcgctgcagtactattcacaatagcaaaaacatgaaattaacctaaatgcccatcaatgacagactggataaagaaaatgtggtacatgttgacatggtatactacacagccacagaaacgagcaagatcacatcctttgcagcaacatggatgagctggaggccattatcccaagcaaactaacacaaggacagaaaaccaaatacagcatgttctcacttgtaagtaggagctcaacactgagtacacatggacacaaagaacagaacaatagaaatcagggcttccttgagggcagagggtgggaggagggtgaggatcgaaaaactacctatgggttactatgcttattacctgtgtgatgaaataatctgtacaccaaacccccatgacacacaattcacctgtgtaacaaacctgcacatgtacccctgaacctgaaataaaggtaaaaaaaagaataaaatagttgttttacaaatattccatgtttttaaagtttcatatatattagaaattttgtctattttctgttttatcagtgttgttaattgcgttagttttttgtctaactgaaatgtcaattttggagagaagaatatttaagtcttcttgattaacttcttgaaactataattgcagtattctcattgctccttctatttctatcagtttgggataaatatgtatgtttcatataggtgcatgacttacatcttctagataaagtataccttttaacagtataaaacatatccttcccaggtaacattcttttgtcttaaattctatttcatctgatttttttttttttttttttttgagatgaagtctcgctgtgtcagccaggctggagtgcagtggcatgatctcggctcactgcaacctccgcctcctgggttcaagcaattcttctgcctcggccccctgagtagctgggactacaggtgcatctgccaccacgcccaactaattttttgtacttttagtagggatggggtttcaccatgttggccaggctggtctcaaactcctgacctcacgtggtccgcctgcctcggcctcccaaagtgctgggattacaggcatgagccaccatgcttggcctcatttgatatcaatattgtttcacccactttcttttagtgagtatttgcctagtgtatctttttccattcctctgttttaaacttttcggttgtattttctttccgttacatctcttataaacagcatttagccggaatttgactgttatttttatccagactctttctcttctaataggagattttagtgcactcacatttactgtgattactgatgcatttacatttaaactgctatcccatgtgtcactcggctccagccacaatggactcctttccttccttacacatagtctatgtcttgcctcacagtctctgtacttatttcccctaccttcctgtgacttgcttcccctcttcactgatgtctcagctgaatgtcctgtctctccacaggccttttctcacaatatctcttaactgtgctttaaaaaaaaaaaaaattcgctattattacctgaactgatacctactagggtactggcttaatgtctatttccttcactgtaaactccatgagaacatgggcctggtctgttttgttcaccactgttggcacttgggccatcttttttttatttttgtaatagagatggggtctcactatgtgccaggctggtctcgaactcctgagctcaagcaaaccttccacctcagcctcccaaagtgctgggattacaggtatgagccactgcacccagcctgggtcatcttaaactaaaatattacagtgtgtttttggaagattcatgagccaaattggatttaagtttacagctgtttgtggctttatgaatggcaaaatgggaaggtctgaattctcacaaaatattacatttttttccaaaaaagtgatctgctaatagaatatgaaatatcaattttagagactattgcatttttaagcaccttttatattttaatcactatgtatcttaaacactattagaaatttttggaggggtttctcaacttggcaaacaggcaattcacttttagaaatgagacaaatattcagtttcagatgaaaatatgaagttttgtcagtacaaaattcggctactcctgattaaattacttcctatttgccattttgggcaaaaaggtcattggaaagcagcaattctcttcataggaggaaacagaattatcttttttcataattaaatactatctgcctagaaatcagaaagtctgtaagagattgtgaaggaggctgggcccggtggctcacgcctgtactcccagcactttgggaggccaaagagagtggatcacaaggtcaggtgttcaagatcagcctggccaagatggtgaaaccctgtctctactaaaaatacaaaaattagctgggtgtggtggcaggcacctataatcccagatactcaggaggctgaggcagagaagtgcttgaacccgggcggcagaggttgcagtgagctgagatcatgtcaccactgcactccagcctgagcaacagagtgagactccatctcaaaaaaaaaaaaaagcaactgtgagggaaacatgttagcaagtctgacacatatccttcgttaagctttcaggagattattcagaactttcttcactcaaaggactagctctttatttgccagatgtcacttacaaacatacattttccatattttatgtgcttctttggtacctccagtaagagtataggagactcaaaaggggaataacaaggaaatttaaaaatcatacaatgttaataaaatagaaatacatccttatctctgaatttctatagtacctaatagaaaagaaaacaagaaatgtatatgaagatatactactgtaaaaaccttttagaacaactttagtgggtaagagtcaccaggaggacaggttaaaacaccaatcaatgggtgctgtccccagatattcctattcagtctgcctggggtaaggcctgaataactgcctttctaacagtctctaggtgatgctaacactgctggtctgggaccactttgagaaccactgttctagactattatttcaaatgcttgctttaggatcaaggtaaaagctatgtaacaagaatatcaactatgaagacagttttcatttgatctttgttgggagagcagctcatgtatctctcatctcaattttattgcttagtttgaaatttttctgtaagagacttttattaagtaaattatcttaacattctgaaggtacaaatagagtagaatgtcatatatcagaataggctggctcaagcatatataaatccaaacaatttagtgcaagagtcccaatatcaaatgcccctaagtgtcagacaggtcagacagttaatacaaatgagtgaagtaggtcaaatagtgtgaagaattagagaggtcatacctaaagagggcagctgccactcagctccagacaaccattaaccaataatgtaggtctactgtagccagatctttcacattttcaaaataagctggagatccaacattttgtgtaaaatctcataagtttttaacataagcaactaatttttaaaaattaaaaatttaaacaccgtataggacacacagaaaggtctgtgagctggttgctgccagtttatgacctcagatttagaagaaagtctcaggaggaatacaagtcatgcaatgtgctaacctggtcactgtgcaccatgggcccactccccctagaagtcatctacttccaaaataaaaagtactctctctaaaagctcctaaagctcctccgtataagtagcttgcccaccaaaacaagtttcctgccaatgatcttagtatgagaaaactgtggcaaagagaaataaattctttacacgttgaaactactgatccaagaataatgattagaattaaagttgggcaaaaggcctgaatagacatttctcaaaagacatacaaatgggcaacagtcataagaaaaaatctcaatatcactaatcattaggaaaatgcaaactgaaaccacaaagagccggtacagtggctcatatctgtaatcctagcattctgggaggcccgggcaggaggattatttcaggccaggtgttccagatgagctggggcaacatttccagacctcatctttggaaaaaatttaaaaattagccaggcgtggtgatccatacctgtagtcctaggtactcagaaggctgaggtgggaggattactacaggccaggagtttgaagctgtagtgagctatgatcggaccactgcactccagcctgggagaataagcaagaccctatctcttaaaaaaaaaaaaaaagagagatatcatctcaccctagttagaatggctattatcaataagacaggaaataacaaatgctggtgaagatgtagagaaaggggaatgttcatacgccattggtaggaatttaaagtaataaaacgattataaaaaacagtatagaggttccttaaaaaattaaaataggtctactatatgatccagcaatcccactgctgggcatatatccaaaagaaaggaaatcaatgtatcaacaagatatctaaactctcctatttattgcaacactattcacaatagccaagatatggaatcaacccaagtgtccatcaatggataaatggataaagaagatgtggtatacacacaatggaatattatccgccagaaaagagaaagaaatgttgtcgcttcttttattgcaacatggatattactggaggtcattatgttagctacaataagacagagacagaaagacaaatattacatgttctcactcatgtgggagctaaaaaagtggatcctatggagacagagtgtagaatgacggttagcagtggctgggaaagaggtgaaagagggatgaagagaagttggttaaggggtacaaaaatatgtcagagagaaggaataagttctagtattcgatagtacagtaggaaaattatagttaataatttattgtatacttcaaaacggctgaagatttataatgttcccaacacaaagaaaaacgtctgaggtaatagatatcccaattactctgatttgatcactacacattatgaacaggtactaaaatattacatgtatcctaaaaatatcataaacaatattttttaaaattaaaaaggattaaagtgactgggttttcaaaattgctaacttcttttttttttttttttttttgagacggagtttcactcttgttgcccaggctggagtgcaatggcatgatctcggctcaccacaacctccacctcctgggttcaagcgattctcctgcctcagcctcccgagtagctgggattacaggcatgcaccaccacactggctgatttttttgtattgttagtagagacggggtttctctgtgttggtcaggctagcctcgaactcctgacctaaggtgattgaccggccttggcctcccaaagtgctgggattacaggcgtgagccactgcgcctagccaaaatcgctaacttctaaaacatttaaaaacaaggaaactaagcttagaagtactacagatttgaggattctcaagcattctatcacaataatgatgtgatttggtacccagtagttaaacatctttgcctgaagactggctaaactgagaaatcagtccttatacacatgttgaagacaactatacaggcaacatggaacagacgcacaataattcaaatttcgtaagtctactatgattagcagtggcagcctggtgtgctgtgttaagaaggattctgaagctgaaccctgattcagtggaacagatgggtgccaaaggcctagaagaggagaatagtagcagatgtgccccataatttgccacctttgaatagtaaataaaaacactgcacctgtgttcagaaacgctacagttctcctataatgtattaatacagcaactagaataataccttttaaatataaataaggtcaagtcatcccttccaatggtctttcattccactcaagagtaaaagctaaagtcctttttattacacaaaaagccctgcattatctcgctctccattatatctctgatatcatttcctgctgcacatcctattgatgccattccaaaacagactgtttcttcgttgttctgtaaacataccagccaagtccctgcctcaggatctttgcatctgctattcctgctgcctaaaaatctctcctctagatattcacatagttcacatcctcatcttcttaccagtgagaacttccttgactactcttatttttaaaaaactatgcacacacacacacacacacacacacacacactctttctgtctcctaacctcccttttgctttatattttttacaatagttgctaccatttaacacactaaatacttattttccttcgcctagaatgaaacctccatgagggatgggtttttggctgttctgttaatgaccacatccctagaatagtgtcaaacacatgacatccaaaaaaaaaaaaaaaaaccactggataagtaagtaaatgaacaaacaggtaataaaacaaatagcctgggttctatcatgggttcagtgactaatcagttaatttacctcagatgagttattctggtcctcaaaggatctctaccattagttgtataaactgtgatattcctgccattttataaaagtagaaattaagttatggaagaatggcgtcatttcctctaggccagtcagtagtatagtggaaagccagaactagacaggcctaccagaattcaagcccaatgcccaatctaagttcttttataaacaacagaattatgacagatggaggatcaaacttcagaattttagaatgtaaaaataaaaagctcctgaagagaaaaatcttttctagtaatagtcaagaagaaaatgcagactccttagcttactttttcccaaaatttttattgctctactccttaaatgcctatgaacattaataagtgtctatggttgagggaaaatgttccacagtagagaaaggaaaacacatccagtttttcatatgaaactggaataattatacattcatcctctgaaaaaaactgagaataatcctttcagcagggttaaaattaggagaatagttagcaaaacaacaaggacaccacaaaacagtgtcaattgccctccaatctaattcttaaatataaaatcaaaaccccaaataaactattaaagacagttgcaatttcatttgatgattgaatacttctctcaccatgaacaatttctaactggacaaaaataaaaactgaatatggacttcgaaagcgaaaaagatgccactaatcagggaccagagaactgcccaaacatcagtcaaaatactgtccttcagctcagtagacactgtcagggatggtttaggagactcaaaatgcacaagaaaatgcttgggcactaatgtgtgatatttcaaataacttcccctgaagacataaccatttacttccaacactacttacaaactcgtagtctccatcctgtggtattttccaatctgaagaatttttcagtggaccaggtacactcttgccaaagctgttgatctggttttccttttctttttgttcaaaatattcaagaaaggatggtttcgcaggctgcatggtctcatcccttcctgaaaacaaagaaaaatgaaaaatgaaaagaaacattctaaattttaggtaagtttaataaatagacatatctccagatgggctacaatctctggatcagtggatatttctgttagataaaggactccttcaagaatctagtgaaactacaaaaaatgcacaaatccttgcccaaaaaattctcatggaattccagaggagttaagatttcccctaaaatacattcagaaatttccctggggtccctctttctaaatggaaagatttgggtgatgcaatgattctgataatctgcaaataatacatttggagtctcccatagcaaacagctcctataatatttagaatgagacagaagcaagcaaaaatatttagcatctatcacatacaatattctctataggcatttaagtaggaagaggggatgatacagtagggtgactttctttgataatctcataatctaactggaataatgagaaaaacatacatgaaaaagaaaacataaataaatcacaattcatccactctatgaaatattaggtaactttaaaaatactatctacatatggcttacaataaacttacaggaaaaaataggatacagtattatatatacagtatgattttgactctataaaatcatacatataggaaaaaaaaaaaactaggggaaaatacccaaaatgttaacagggtttatctctggtagtaggactattggtgattttatttacttctcatgaacatttttttaaataagttagtactgggtcaggcgcggtggctcacgcctgtaatcccagcactttgggaggctgaggtgggcagatcacaaggccaggagatcgagaccatcctggctaatacgatgaaaccccatctctattaaaaatacaaaaaattagccgggcgtggtggcgggcgcctgtagtcccaactactcgggaggctgaggcaggagaatggcgtgaacccgggaggcagagcttgcagttagctgagatcgcgccactgcactccagcctgggtgacagagcgagactctgtctcaaaaaaaaaaaaaaaaaaaaaaagaagttagtattgaacaggtataaaataaatagaattgattaaaagaattatatgtgcccagttcttgcatgctgtgtggtcagggaagactggtaaaaggggacttagatggggcctcaaaccatcctggagaaaagcatcagcagttacatagtagcagtaaccgttaagagagcagaatacagcagctattagttattagtaacaagagcagaaagaataattttacctggcatgatttaaaaatcaaactagctgaatgtacctgtttcaaaggttgaagtatctttgtgcctctgattagtattctaatacagggaaatacaggaagtatttttcattgctttccatgaacataggggtttatacggccctttcctacagtaatcaggaaaaacaaccagaaggctcagcaccttaagaagtagatgagaaggtatctagaagataaagaacagcaagtgtttctctccaggcacccttggtctatgcaatcttacttatttcatgacacttcctagtccagtttcaggccagccaccctacctctcagaacatttgtcatttttctcactatcaccattgctaagttcaacagcagccaatcccgtatctgcccatatccacagactgccaatggtttcctactacactgttttctcctcactaattaagaattaaatacattatttgctaggaccaatcagcaagtatatggtgttttgttttgtgtgctctaggtatgatgttagagccatgatcatgcaactgcactccagcctgggagacagagtgagacacggtcccaagaaataaaaaggaaaaatcagtctttgaccactttattgtggtaacaaaaaagagcaactcctttgtaggaaatacaaacaaaagagggtatcttctttcttaggaaatacacacttaaaatttgagagtaagctgcatatatcacgcaccaacctctcttgtctcattatttctgtcattcacgtctgtttatccatccatccattcatttttatatatgcacagataaatgactaaattgagttcatcaataaaaatggcgacttctggacagaaataacaggtaatttaaaactttttctccaatggaatttacaaaaaccataagggcgtcattcttttttaaaatgtattatatccaacaataaaacaatatatttctatggttcttcattaattactttcagttgcaatacaggtggacttaagaaattgaatctttaaaccaaggatgatgaaacactaaagataacatttctgtggtctaattctaaaccatgtcataaaaatcaaagaaatgtctgttaagtgagaatataattatttgtctatttctgtcactgttcagatgaaaaagtgagaacatctgcttgcctcatatttgagttcttctttcttaccaacccacttaaaaatttctaatttttggagttaaaacaccaactgttctttgtctctttcaacaatgaaaatccacaaataagaaagtctatctaaaatgtatttgcttttaccttctgatatcaataccagggacctgattatacctgacatttattagaattcgaagttccaaaaactaaagtgaaataaaaagagaattttttttatctaaccacatattcagatataagctgtaagtaaaatgcacatatgtattagaaatttaattatagcaaaatgattagttaaaatgttacatttatcagattgccaaaaagctaaagttgattttggagacagaagaacggaaaaattcctctcctcaaattttatgttatgtatattttaccacaataaaaaaaaatggaaagtaatccctatcctgcagttcaaagatttagattctggttctgactacacgatcttggtaaaaccacaggttcccaatctgcaaaaagaagacacagggccagattatatctaatgttccctgcagctttgaaaaattccgtgattttatgacttggcagtagcatatgaaaacatatttatgctcagttattaataactattcaaaagaagaagttcttatctctagtaggattatgatactggatgcctctcatctaaaacatgctacaactagatgtgtacaggcataaagcaaagaccaaagtgaaaaatagttaagactcaagaaatattttagtgacaagagtatctctgattctttggattttttgttgttggtggtttaacagatggaagaggtaactcaaactgtaataaagatatcgtctagagatgcagatgaaatattttatggaactaaagtgaaaaactgaatgaactgactgataggggaagccaccttaactggcaagaaacagcagacattcaaaaacaattagctgatccttgtatttagtgattccagaaaataaatgcctccaccataatgattctttcttcatgtgtgagagtgctttactgacatgttaagtttatatgaagaagacagcagtattcctattgtgaataacactgtcattacattgcagcacctgtactaagtctgattttatagactgataataattctcagtaaacagatttgcattcctatcacaattagtatctaagataaattgtttttaaaaatggccacaacaatttcctcttggtatcttcatccttaccttactccctctcacaatgactctgggcctggctatctaacctgctttgggcattgagacaatagcaaatgtacagcaagaagagacttaaaaattcttgtgtaggctgggcatggtggctcatgcttgtaatcccaccactttggaggccaaggtgggtagactgcttgagcccaggagttcgagaccagcctgggcaacatagcaagacctggtctctacaaataataattttttaaaaaaattagctgggtgtggtggcacgcacctgtggtctcaaatatttgggaggctgaggcaggaggatcacctgagcccaggaggtcaaggctgcagtgagctatgatcgcacaactgtactccagcctgggtaacagagcaagaccctgtctcaaaaaaaaaaaaagtcttgtatattttactataatataaataaacctgattgagcctgctagatggtgaaatactacgtggagaggcccaagtcaacaaatgtctcaacaaataaatcagccatccccagctgttattgcaccagctgaccacagagcagagctaaccagctcagaccagaattgcctgcctacctgagtccaacctaactgccaacttacagaatcatgaatcaagttaaataaaatggctattttaaaccactaaattttagggtggtttacaatgcagcaaaagctaactgacacagtttcagtatctctatctcacataaacataaacataaacataaacataaacatacacacacacacacacacacacacacacgcataaacatacacccctaaatctggaaaaaagagttctattctttggaaacttaggttcaaatttaactaacattcactaaataccttctacatttcaggctttctactaggtgctttcacataatggtctcatccaaactgcacatccaaactgcatgaccaccatataaagtagagggggaaaagccttacacttaataggcatctatcaagtgccagaaaatgtactatatcacttaatcctcaaagagtcttttgagatatatgttatttattatgccccttttacaagtgagaaatttgcagatttctaagctagtaaccaacaaggatgggacttgaatgccaaatgtcaggttttaagtttagtgatctacatctcatattgtacagtctctaaaatcaaaataaagattcttgacatgttagaactgccattaaactaagtgcagaaagagtggggaaatgtaattttcccagtaaccttatctttgaacttttctttcagcacccgttagctagatagatgatcaagtgtgctggacagcagcttgtcaggttgaaaagtgtaagagaatcattccaagctgattaaaggccatgctgtcccccagggcttcagctagcttgtgggttttttgttttaacttgagctagcatattttttcagatgtatcccaagaaataaagatgttcagctgaatgataatacaagaaacctaaagccgtagaaagaatggactgaagagagaaatcaagccttgaaaataccacatcttgctctgattcttttatctgatgccggaaatgcatgaattcctatgctaagactggcctatttttctttgtaagcagcatttgtcaagctaaatgaacaatctgtctaagcctacagacaaagcagtgaattcataagcaactgtatcttccatttatttttctttgaaaaatgctacgtaaaagcagaaggaatcaacaacccaaatgtctatcagctgatgaacagataaacaaaatgcagtgtatccatacagtggaatattattcagcaacaaaaagaaatagtgatacatgctataacatggataaacctcaaaaacattatgcaaaatgaaagacgccattctcaaaaggccacatgttatatgattccatttacataaactgtccaaaacaggcaaatctatagagacagaaagtagattaatggttgcctgggggtgagaggcaaatgagaagtgactgctaacaggattagagttttttgaggggatgataaaaatgtcttgaattcaatagtgcttaaagttgcaacaccttgttaatatcctaaaaaaacactgaattctatgctttaaaatggcaaattttatgacatataaattatatctcaatttaaaaatagtggccaggcatggtggctcatgcctgtaattccagcacttcaggtggccaaggcaggaggatggcttgaggccacgagttcgagactagcctgagcaacatagtgagaccctgtctctacaaaaattttttttttaaattagctgggcatagtggtgcacacctgtagtcccaactattcaggaggctaaggcagaaggatcacttgagcccagttcaagactgcagtaagctatgctcatgccactgcacttcagcctgggcaacagaccaagatcctgtctccaaattaaaaaaaaaaaaaaaaagtagaactttaaaaattagatagaattttaaaaattagattgtggtgatggttgcacaactctgtgaataaactaaaaaccattaaactgtacactttaaatgaacaaattgtatggtgtgtaaattatatgtcagtaactcaattttttttaagcagcaagacacctttccttaactatttgctcttatttctggattcatatgaactacaacataatgtctaggtagtcataactgggaaggaccttgaccaaagactgaagcccactgttccattggaatgaccatctactagaccttaaacttcatgaccttcaatttcaaaccttcattttccagactgtcactaagtaaaccaatatggtcaacctactgtttccttaattcctacaatgactcttttctacttaaattgtaattaattctgtgcaaaccagagaactgggcagagcctgattttttttctctgtttcatgcatgaatgtttgcaggaaaaacaacaacaacaacaacaacaacaactctggtaatcctgcaaatgttttcctctggcttggaatagtatgccttaatgtgcaattcttatcacagggtttgtttttttctaacatttgttatgagtgtgtggttttgggttttgtttttgttaccaggcacctaagtgctttacatgtatcagctcatttaattacactggttactatccaagtagctgtgtacagccataaatattcctttgaatgtcctttgaaaccactaagaattgctggaatcataagttataaggttccctggagcccagaataactcttccagttaagcagtttcagtaactgcctctatatgaatggacttaatttctgggcaatggtgctctagctgttttaattctggtgaactgaaatatataaattcaaagagagctaaatccaaaattcaaaggattactaactagagcaatagtggcagcacatctaaaaagataaaaaatgttcacaggtgagaatggtccacatcttggttcttgcaagaatttcctaattggtctcaccttttacagtcttttgaaactccattttatcactttcctagtcaaagtgtcttcagataccctattaacaagagaatcaggttcaaactccttactttcaaattcaaagtcttccaaaatccagtcaacacccacatctgcttcggccaacctgaataatgaaaacacatttctacctttctgactttgcacctgcctgtaacatccttccccagccttcctgcatatctgagtcattgccttccttttcacaaatcctttaacgctttcctgtaccacttacctagcatttgtcttagtatattattaccttcatatgtagaagtcctttctcctacgtcgcatcattatcaaatactattatttgaagcgcctagagtaatgctctatacacataaggaattagaacaattagaacagtacacatgccataagtattagataatgataatgacaaatgtcatcttccccttttaatatataagttactgaaagcagtgaatgcctcatttggttttcatactctacatgttaatgacacatagtgactatttaataaatgcttcttggttggtattaaatattcattataaacaaatactgattccaaattgatatttatagagcataaacatttgaaaagaatcatctgctttttctttatagatccacttaaattgatatttaaaaatgtatctccattttcttgctgaacaaaagaaggtcagaacagcaagcttagagcaacagagaaataatatattccactaactgatgaagaaagatttatctgcctcttaggcttaaggaccaaagtatattgtttgtgattcactttcctatgttcttcattaccattatgctactgccctctcttgaaaaatgtatttccctcatggctgttcttggctctccttttaccaatataactatactggagtagctatctttcaaaatatataggccttgagcccttcactcaagttatactgagatctggtactttcatatcctaaaatgtggtctggcagggtgttctgaatgaattttcaggcatcaggagttctgtgctttttggctcattccaaaagaatcaagaatgctaatggtttccaaagataaaagggggcccaacatctggatacaataagaaaaactgcacaaacaattaggatttagtctccactctggcaggacaaccttgaattatttttgaaactgtgagaaaaacctaagtaccaagatgtctgctcttctattgtaaatctcacccacgagggagctactgataaaatgcacagtgaaccacagtggttatctttcgggggtggaaaaaaaatccagtcggtaataaattccactgtattaagataagaggctgaaactttacaaaagaaggctcatgtgtatctaaagtctggccctcttaaaaatccgtcaccttgtattctgggctatttaatagattctcaaaacatgtatcatcttattgccaaggaatttaaaacacagacacacacagacacaaaccacacagagcctccctctctcttctcggcacaatggtaaaatgttactgaaactgacaagtgaccttcccttagctcaaccatgttcatgccagcactcaggcattcctggggtggcacctacaaaacatcatcaataccaagagcaaaaactaaaagttagtaaaaagttagtatcaagagaaaaggaattaggaagaagaaaagtagcactgttgaagaaatgtttacgtccaatgaaaaaaacactctcatacattaaaagacttactataatacctaccatttttgagcatttacacattaaatattttacacatacaatctcatatcatcttgacaaaactacaaaataggaactttggtgccccattttttcagacaaggaaactgaggatcaaaaaagaaagaacctgaccaaggtgacgtagtctgtaagaccctgagcaaagtttcaagccaaagactgatgctaaaaatcaatgttcactccactactcctttgtccttctcttgcccttactcagagatagggttccaacaaaatcaaatgttttcagctttagttttggggtgcataactggactaatgctgtctgaaactctcatgtgatgctgactgtgagtggcaagcatacaccaacacaatactctgatgatagatgtttaaatcctgaagggatcagaaattggacagtaaggctaccgtggtaaaagaagtgttaaaatacttgcagtactttatgtcctaattactgtacttgcaaatgccataatctgagtcagtgagaataagacagataacacacaagggagacaatgttctaacaacccctttcaaactgcagatggaaagaaaataggctctgagtcaagaattcctatcttatgcagctctgaaatcagtatctgatggacggtgttgaagtaaaatcattttgacaacagcctagcctttcacctgatttcaacatgaggaaactcacagcaacaataggtgccttcatgaaacttaggactttctgaggaactataaacacataatgtttttaccacaaaatactatctcagtaatttaactaaaacatgtctcttagttgccctaacttaattatgtcattatgctttaaaattctgtttcaaagagattaatgtggctgttgctctgggagaaaaattagaatcttatgcactaagtacaagttttaaagaggaatcatcatctcactcccttcaattcactgaatctaatttgaaggcttggtcaggggaaacattctttcaattagtagtccaagttctgcctcccattgacctattaagcctggagatgaggaggggtgaccagggctatgcatctcttgggaatgtggtaaggacaagaaaaccatgacattatcgccaatgaatcctgagaggaagaaccgccgcatgtcaaatctttagtggatgagtacatgttactgcaagtggccatcctttggcttgtcatttcctcatgaggggcaaaagcatttaactgctaaactacaagtctgtgcaaatcaagctacttcagttgctccaaaatgtttttgttatctttgccactaaaaaaaaaatatttttttgctttcaaatatatactttttaaatatttaataatgttgtgaaagcttggattctttctacatcaagtataaaattaatcctttccattttattttattttattttattttgagacagtcttgctctgtcacccaggctggagtgtagtggtacgatcttggcccactgcaatctccgcctcccggtttcaagagattctccttccccagcttccttagtagctgggattacaggcacgccccactacacccagctgattttttgtatttttagtagagatggggtttcgccatgctggtcaggctggtctcgaactcctgacctcaagtgatccacccacctcggcctcccaaagtgctgagattacaggcatgagccaccacatcctggaccgttttcattttagctctaaatattaacaccctatttcataatgatcaaataaaacagaagaaattcttctgctttaaaaaaatggttgcttgaaaacggataatggtgaaactattcttctgcatattaagataaaagaaagagaaaatatataatttaatataaaagagaaaatatgcaaaaaattccatcattttcacagtactaccaattgtattcagtgccaccagtatattattttggatgacatatgtgagtaataccaaaattaacaaaacccacaaccacacagtgacaattttaacaatttaacaattttaacaaatctccagaagctaaaagatcaagtatcaaaaattggtaaagatagacaaatgaaagacaattagcaactgattgctaattacagattcctgcaccaaacaattagaaaatacattatttttaagacacacaaagcacatttaatgaaaattaataacatgttaggccacaatgtctcaaaaaataacaaagaattgatataacagaccacactcttcaaccacaattctataaattaaaaattttaaataagcagtttttaaaaatcatacatttgctattaaaaaacacttccgaataactcatgggttaaaaaataaatgtgtatagcacaagcactacacactggaaaaaaatatttacaatataccacatatgaaaatgtatggaatacagctaaaacagaactaagagaaaaagttacaatgttgattaaatgtattagtaagcaagaaaattaaaaagctaactattcaaattaaaaaaagacaaaacaacattaattaaagaattttttttaaataaaacctcttaaactaaaaataaaccaaaacttatttagcctgttaaggggtatcgaccaaattctgctgcaaaatcagactccatggtaaaaaatcccaagaattttctttaaagtgagcaacaagacaagaatgtccactaccagctctactatgcaacactgtattggaggtcttaataagaaaaaaaccttggccaggcttggtggttcacacttgtaatcccagtactttgggaggttgaggaaggaggattacctgcacccaggagttccagaccagcctgggcaacacagggagatcccatctctataaaaaaaaaaaaaaaaaaaaaaaaaaaaaaatcacaggtgtggtggcacatgcctgtggtcccagctactcaggtggctgaggcaggaggattgcttggccccaggaattcaaggctgcagtgagctaggatcgcgccactgcattccagagtgagacagtgcctcaaaaaaaaaaaaaagaagaagaagaagaagaagattatatataaagatcaaaaggaaaaactataatcataattcatagacaataagactgtctccatttttttaaaaaggcaatctccataaaacctgttacaatgaataaaacagtccataaatatctacagtagttgtctatagaagaaaaatgttagaaacaaaagttttttaaactatgccatttgtaatagcaacaaataagtatctaaaaatagatttaacaaaaagctctaaaacatctttgttggtacaattataaaattatctaagaatataaaagatagaccaaacagattgaaagataaaccatgttcatgcatagaaagaattaacacagagatggcaattctgcctaattaatctgtgtatccaatgcaattaagtcaaaattccagtagtattttataaaatttgatatactgatcctaaaatttatatgggagaggccgggtgcagtggctcacgcctgtaatcccagcactttgggaggctgaggtggacggatcacgaggtcaggagatcgagaccatcctggccaaaacagtgaaaccctatctctactaaaatacaaaccattagccaggtgtggtggtgcgtgcctgtagtcccagttacttgggaagttgagacaggggaattgcttgaacccaggaggcagaggttgcagtgagctgagatcgcgccactgcactctagcctggtgacagagcaagactccatctcaaaaaaaaaaaaaaatttgtatcggagaagagtgatataaatttcaagaagtaatctgtgatgaaaagaaaaataaggggatgggaaatctattgcagacaaatagtcaaagaaggactgagaaggtgacaggatcaaagacctggatagagggaggaagcaagtctttcagatggaaaaataaaacagactactagagctcatattgtaaacaaaaacaaattcctgatctatatcaggaatatatatatttttactgttatttactgtaacataagccttagtcctggctcccaacaacttgacttaaaaaaaaaaaaaaaaatatatatatatatatatatatgtatgttctacacaagaactttcaaatcagttctacacaagaattattaggttttttaaaaaatttattcagttattcaagtaaggccattttagctgattacagtttaaaaactatatgcatggtaccatgctacagaaaaagaacaccaattgtgtcaagtccactgagaaatctgggaagggagagaaaaagtgactattttgagatgttttggctgacttcttatttgaactttgccaagtatgaggtatccaatctcccaactaaataaaataaagacattgccctagtgtcactgcggttacttaaaatacacttaagaatgaataagtaatggtcttgttctagcataaaggctacttttatataaaggggatttgtgaactcaaatgggaacacgattataacccattaacttaatacagagctccctctgctggcccagagaatgcacaatgatcctaacactgacacagaccctctcatgtcacttcaataatgtgtcctgctgtttggggaggtaaacaaggctattctagagcccttattcaaaaacaaaaacaacaacaaaaacaagaacatatctagacaaatagaagaagccttccaaaatccccaatctaatattttatccagacagaggttttccaagtaacgtggaccatggtttgcctctttcgttctcacatgtatgcttgaggccacttaaaatcaatcaaatcccaccttaatcccttctctccaactgcaatctgactccttcctatagattcagatacatacatccaaaacaaattccctcagaggtaacaatatcattagcttatcagaggcatgctccctttgaaaaccatctgtcctttctttctggaaatactgaggacatatgtagagtaactggttatcaaaataaccagcaaggagaagtacattactacaagctgagactcaccaacacatgatctgtaacataagccttagtcccagctcccaacacttgataaaggggctctgctagaagtagtataatctaatgattcagaacataaccactgaaatcaaacatatctgggttcaaatcttggcttctctattactcattatataatcacaagtatgttacttaatctctgcaactgggtttcaactgctattaaacagggaatggttcaatttaccacacagcatggttgtaatgatcaaaatatgtgaaatgcttaaaggataaatcacagtgtgtggtatatattaagtgcctaatcactaataattattattagcagttataacatctatcctattgagtataacacataagttacatataataaataattgggaggccgggcgcggtggctcacgactgtaatcccagcactttgggaggcagaggcaggcggatcacaaggtcaggagttggagaccagcctgcccaatatggtgaaaccccatctctactaaaaacataaaaattagccaggtgtggtggcatgcacctgtaatcccaatctcaggaggctgagacaggagaattgcttgaacccaggaggcaggggtcgcaataagccgagatcgcaccactgcactccagcctgggcaacagagcaagactccgtttcagaaaaaaataaataaacaaataaataattgggaagtcctagccagaacaaccaggcaaaagaaagaaataaaatgcactcaaataggaaaagaagaagtcaaactatctctctttactgacaatatgattctatacctagaaaatcctaaagactctgtcaaaaggctactagaattgataagcacatttagtaaagtttcaggataaaaaaatgtacaaaaatcagtagcatttctatacacaaacaatggccaggctgagagtgaaatcaagaacacaatcctacttacaacagccacaaagaaaatgaaatatctaagaatacaggtaaccaaggaagtgaaggatctctaggagaactacaaaacactgctgaaagaaatcagagacaacacaaataaatggaaaaacattgtatgctcacggataggaagaatcaatataattaaaatgtatatactctccgaagcaatttacagattccatactattcctataaaattgccaatgacattcttcacggaactagaaaaaactattctaaaatttatatggaaccaaaaagagcccaaatagccaaagcaatcctaagcaaaaagaacaaagccagaggcagtgcactacctgacttcaaactataagactatagtaaccagaatgctgttcttgtactggtacaacaacagacacatagaccaatggaacagaataggaaactcagaaataaacctgcacacctacaaccagctaatcttcgacaaggccaacaaaaacaagcaatgggtaaaggacaccctatttaataaatggtactggcataactgactagccatattaagaagattgaaagtggatccttatctttcaccatatataaaaattaagtgaagatggattaaagatttaaatgtaagacctcaaactataaaaatccaaaaagaaaacctaggcgatacccttcacaacattggccttggcagaaagtttttggccaagtcctcaaaaggaatggcaacaaaagcaaaaattgacaagtgggacctaattaaactaaagagcttctgcacaacagcaaaagaaactatcaacagtgtaaacaacctacagaaagggagaaaatattcacaaactatacattcaacaaaggtctaatatccagaatctataaaaaaaaaatttacacaaatcaacaagcaaaaaacaattccattaaaaaatgggcaaaggacatgaacagacacttctcaaaagaagacatacaagtggctaacaaatacatgaaaaaatgttcagcatcactaatcatcagagaaatccaaatccaaaccacaatgagatatctcataccagtaagaatggctattactaaaaaaaaggtcagaaaacaacagatgctggtgaggctatggagaaaagggaatggttatatactgttggtaggaatgtaagttagttcagccactgtaaaaagcagtttgctaatttctcaaagaacttaaaacaccaatcccattactggctatatacccaaaggaaaataaatcattttaccaaaaatgcacatgcattcatacgatgagttgaccaccacactattcacaatagcgaagatatggaatcaacctaggtgcccatcaatagtggactggataaagaaaatatgatacatatacgccatggaatactacgcaaccatccgtgtaagcagccataaaaaaagaatgcaattaggccaggcgcagtggctaacgcctgtaatcccagcactttgggaggccatggcgggtggatcatttgaggtcaggagttcgagaccagcctggacgacatggtgaaaccctgtctctactaaaaatacaaaaattagcctggtgtggtggtacatgcctgtaatcccagctactcaggaggctgaggcaggagaattgcttgaacctgggaggcagaggttgcagtgagtcgaggtcgtgccaacgcactccagcctgggcgacagagcaagactccgttaaaaaaatgcaattatgtcctttgcagcaacatggatggagctggaggccataattctaagcaaactaacacaaaaacagaaaaccaaataccgcatgtgttcacttagtgggagctaaacactgagcacacatggatataaacatgagaataacagacattgcagactactagaggtgagagggagaaaggggaccatgggtcgaaaaactagctactgggtcctatgctcattacctgggtataatatatttatgcatcaaacctgcacatgtaccccctgtatgtaaaataaaagttgaaattttttaaataaataaatgaataaacaattgtttcgaacaaacaaaagccatccctggattctcagtgaaagacagcaccagaatcaccataactatgatgagttttctattatggatctaacgcctatgaatataataggcaaccaaaacaaatcagaagctctgtggaatgaagagagcatagactctgaagtgctttcttttttttgtttgtttgttttttgagatggagtctcgctctgtcacccgggctggagtgcagtggcgcgatttcggctcactgcaacctccacctcctgggttcaagctattctcctgcctcagccttccgagtagctgggactacaggcgcccgccaccatgcccagctaatttttgtattcttaagatggggtttcaccatattggccaggctggtctcgatcttctgaccttgtgatctgcccgccatggcctcccaaagtgctgggattacaggcgtgagctactgcgtccagccaactctgaagtgctttcaatttccagctccaccacttactagccatgtgaccatgaacaagcaacaatctcaatctctctgaacctgttcctttatagagaaagtggagaaacatcatctctgtagacagttaagataacggaatgagctgaagtgctaaggcctcccctcctgttataaacaaacagaaactcaagacttaaaaaacaaacaaacaaacaaacaaaaaacaacccatagcgctcagaaccagaaaacgaaaacttccagatgccaaaagcgggaaagaaacccacagcactgagccgagtggcctactgggaaaaccaaatcacaaggactttagctttaaggcagatgtgcaaatagcaatcaggataaggcagaaggcaagacatacctgttaaaggggaagccagaactcaattcccagcataaagataggagccaggacaatactgcccagaagcttaagaagatggcttaaaaatggcttctgcttcggtaggtaagaggtggaaaaaatcaacttctagaaatacaattcccttggctgtaccacaagtccaatgtggaactgagaaataatctaaagactgctctagaaagaaataccccatagggccctagggatgcctgtacaacccaaggaatacaaaggacctccgagcaagataattctcaccaaacataagctcaaaaacaaaatttacaaagtgtaagaagaaatgtaacaatatgagagataacaaacacaataaacagaaaaattagacccaaaaaacacaaaataatagcaggatctgaaagtttttttttaaagggaaattgaaatgttcaaagagataaacagaaaaaaatctgtaagacaagcccggagcagtcgtatgcacctgtagtcccagctgcttgggagactgaggtaggaggatgacgagcccaggagttcaagacctgcctggacaacatagcaagaccacatttctgggaataaataaataaataaataaataaatacatccgaaacaaaatgaaacaaaaataaaataaaaaaggagaaaaagaaatcctagaaaaaataataataatagagaaaccaaagagaattttctaaaactgaataaagtcctgggtccttagattgaaaagtacagagccagaagaagcagaattagaaggaaaaaaaaaatccaacatagagacaataagttaaaacagaaaatattcaggaaaatgaaaaaaagagaaaaaagtaaatcatctagaaaagaacaatattgacaacagaatttccatcaccatcaacagataccagaaaatatcaaaatgatctcttcaaagtacaaagagaaaataagagtccacttagaaatccatgcctcagtaaactatattcaaaaaagagaaaaaaattaagacttttattaaccatacaaattataaaagtttgctacccattacatcctactgaaaggagaagaaaaatgagcccataagataaagtataagcttaaagaagcaaaggtaagcaaacatattagtagctcactatgttcataaattgtattgactctaaataatgattatagtagctaacgttttgttttttttttttttttttttgagacagagtctcgctctgttgcccaggctggagtgcagtggcgcgatctcggttcactgcaacctccgcctcccaggttcacgccactctcctgccttagcctcccgagtagctaggactataggcgcctgccaccatgcccggctaatattttgtattttgtttagtagagacggggtttcaccatgttagccaggatggtctcgatctcctgacctcgtgatccgcctgcctcggcctcccaaagtgctgggattacaggcgtgagccacagcgcccagctgctaatgttttttaaaaacctggtgaaccaaagcaatagacaacaataacaaaatatgagagaggcagtttgaaaaaaaggcgaagtgtcttaaatcctttttcttattcaggaagaggagagagatactgattaactttgaaatttattaggaaagtagaaatttaagtaagcatatacttatgcatacactttgccagttggtagaagagagtggagagaggggattaaggtaagggaaaggaagtgatggcggtgaggactcaatcaatccaacagaaggaaagaaaggaggctgggcgcggtggctcatgcctgtaatcccagcactttgggaggccaaggcgggcggattacgaggtcaagagtttgagaccagcctgaccaacatagtgaaaccctgtctctactaaaaatacaaaaaaaaattggctgagtgtagtggcatgcacctgtaatcccagctacttgggaggctggggcaggagaatcgcttgaacctgggaggcggaggttgcagtgagccaagatcgcaccactgcattccagcctgggcaacagggcaagactccgtctcaaaaaaaaaaaagaaaaaagaaaaaaaaaaaggagaaaaaaaggatttcatgacaaaaatatcaaaagcaattgcaacaaaagcaaaaattgacaaacggaatctaattaaactaaagagtctctgcacagcaaaagaaactatcatcagagtgaacagacaacctacagaatgggagaaaacttttgcaatctacccgtctgacaaaggtctaatatccagaatctacaaggaacttacacaaatttacaagaaaaaaaaaaccatgaaaaattaggcaaaggacatgaacaggcatttcttaaaagattattttttttttatttttatttttaaggctagtcaagtgaaacagtgggagtggagaaaaacaaagaaaaaattggttgtggccgggcgcagtggctcatgacttttaatcccagcactcggggaggccaagatgggggaatcacttgaggtcaagagttcaagaccagcctggccaacatggtgaaaccccatctctactaaaaatacaaaaattagccaggcatggtggcacacgcctgtaatcccagctacacaggaagctgaggcaggagaatcacttgaactcagaaggcagaggttgcaatgagccaagatcacaccactgcactccagcctgggcgaaagagcaagactccgtctcaaaaaaaaagaaaaaactggttgtgatcaattagttgtaaacaccactgcactcggactaaccaacagttatcatttttttaaagacatttttagaggccgggaacagtgactcaacctgtaattccaacactttgggaggctgaagtgggcagatcatgtgagatcaggagtttgagaccagcctggccaacatggtgaaaccccatctctactaaaaatacaaaaaaagtagccaggtgtggcagcacacgcctgtagtcgcagctactcgggaggctgagacaggagaatcacttgaacccgggaggtggaggttgctgtgagccaagatcgcaccactgcactccaagcctgggcgacagagtgagactccgtctccaaaaaaaaaaaaaaaaaaaatttagagacgttttaggttcacagcaaaactgagaggaaggaaaggagggttcccatatcccatatactccctgccacacatgcatagcctcccttaacatttataattttaatttccaaggataaacatttcatagaggttcaaataaggaactaaatgaaagtctatccattttcacaaattttaacctctagaaatttcagttctgcaagtcatgaattacacaatttttataaatgtgttgactattagaggaataagggacaatgaaaataaacaagtttagtaataatttaattttactgattagggcactgagacccataggaggaaagtgaattatctaacaccacatagatcagtatctgagccccaggcttgtacctggtccaatattaaatattaaatcaggccaggagaggtggctcacacctctaattccagcactttgggaggccaaggcaggatgatcacttaagaccaggagcccaaaaccagcctgggcatcatagcaagaccctgtctctacaaaaaatttaaaaattagctggacacacctatacatactcccagctacttgggagactgaggtgggaggatagtttgagcccaggagatcaaggttacagtgagctgatcatacctactgtacgctaacctgggcaagaacaagaccctatctgttaaaaaaataataacttaaataaatacttaaaatcaattataaagaaatggtatgatgactcagatttactttgaattaattcattttactattttctagagttattatcagaaaaaaaaaaaaatcttgcccaaaataccactgatgtcatagcatgtcctataaatcaggactttgaagcctgcattaccttaagaatcttttttaccccttactcctctcactgcttttcatggccttaaaaatgaatacttttacaaagtgtttactaattgctttttggtgaggtggggctgaaataagacgggcagtgagttgatcattgctgaagctgagtgatataggtctataggggtcattatattattctgtgtaattgtatgtatgttttaattttccataatgataaatttaagtaactcctaaaacaataaggaatttttaaaaatctcaaaataagtggcaaatctgtcaaatctgtaatccaaaagggagaattacaaaatctgcaacagactgtctgtgaacaaattgtatttaatgttactcagactgtgactgcttaggtttttaaacagttctcttcatgattataataaaagatgcatgtttctcattagacatgctaaaactatccagttctgaaaacaagttcagaaactgaaaagaataaacaactcattgaattagcatttgaattatgaaaatcacatttggaaaaaaattaattctttaaataaaaatgggcacaatttccctaacacgtgcatgtacaacacatactaacaggttggcctagttgtattacacagcggttataatcatctacataattaaaccccttaagacaagtagacaatttagtactcagagtcaatgaaaataactagaggtcagtagctcattactgcaaaatgaacattactaacaaatcatactggctacttttaaaacaggaggggaggagaagggcaatctagtacatggcatttagttgataatttgtacatcatcaaacatgggatttctacagtgccttaatcttgagtttaggggatgaaacataaagcaccacgagcactgaatgacacaagaatttcactctaagataggagctgaacacaagatgttaggcctagtcacaggcaaaaaaggatcagccagatacggacagaagcagagatgagtttaaactagaagaaactggatagaacttttcaacttgtacagtcatctttcattgactgacagtattggtaaacttgggttagacccaaactgtcatgaaaataaactgaagatgtatgtacagtaaataactcagaatgtcattacaccttcacaggaattatgcatcaaacaatgcatgtgcttgcctccaaagatcaaggtaaggaaggaaaataataacaacattcaatgagaaaatggctgctctggttcaaaagcaaaattctttctcactgttgatgctttcttgactttgactccacaggccagctttccccctcaccaaacctcctgtccccatcgcaaacttccaagttttctactcctttggttgtgacaaaagaaagaacccaaggctaagcctgcatgaaccatgagaatctgtcttctctgaaatatgtatgcttggtctaagaagtcagtgaatttactcagagccttacttttcatagttccttcctcttcctcatcctctgcattgatcaccatggtgcccagttgtgatggcaacgtgtcatcgtgctcaatcatagtattggctccatcagtcatggtgctggctactcggacagtgcccatctcatcacccactgctcgaaccatcgtgccagaatccatttcatcctcttcctgtaaaaggatacaatctcaaattggggctaatttgacaaaagactttgagttttctgaataactactacctgtcttagtgaaaatatttcgagatttaacacttattcaggtcctaaactcaccttccagaaatgaaagcgctgttacttaagcaaagaagacaaatttatccacgtgataataagcagtgtatctaaccctaaaggaattcttcctctactcttcttaatagagttttgtgacatagatctaagaaactcatgtgaacatctttggaatctcagggttgtgaagaagtctataaatgtaaaagctacatgttaagtatggatcccagattccccaaaaggatatgaaaagccaagtcccagacctgagcattctctctctaaaataaaaagttaaattgagtaaaagaggggcaaagagtaaaatttaaaagtgttttaggaagcactgggagaagaataagcacagatacaacaaccctctagcatgcgttgatccaggttaggacatagttatgctggaagcatctccagctccaagttgatccaatacctcctactcatcttacctggtttggcaatcataaaataacaagcatcaatgtctgaggcccacagcaacggctgccactcactgagttttcttcatcgtcctggtccacttcccgctgctgggattcctggcgtttcagtttcacatccatggcttcattaattaagtctcgcagtattgacactcctttggcactcctgacaaatgggtgctaaaagaacaaagtagaaaatactggagacagtttatatggtgacagtgccaaaacagtacctggaacacagtaggtactggataacatgtgttgaatcaatcaacgaatctgatctttctctttgtgcttcggacaacagctaaaccacactcgctttataactctgagtagagcaaattcagtctttgcctatctttttcagcctggctgaaatgcctatgccatttctctctgtcaaatctagcgattctcaatagggagtatcatctcctggaggaacttgtgtaaacatgttgggaacatgttatagctgccacaatgtttggtgagcacaaatggcatgggacattagcaattttgcaaagtacagaactgtcctgtacgaccatgaactgtggcagattctgcacatttttcaaatgtctcagggtgtgtatacaccttagtagataatactaaaaaaatgttttcaagagatatgcaaaaaggccagtgatttgggaggtgattttagagaggggagcttaatggaataaagaaattatttagaaatcactgaaaaatctactcatctgacttgttctttctatggtagcatttccaactacacatttaggtaaaaaggattttagtgcaaaaatgcagttgctgcagacatactaaaactgatcatatatatgtaacagattttgacccaaatattattcaatcaccaaagatacttgaaacaaaggggtattgctgaatttcattaataaaatttgctttataagtttttaatattaataccatcatatgtttttattgtttgtatttgtagcacgtgataagaaatctatgctgtgaaagttacatatggaaattctttttggggaattgcctgttgtcttccaaacttactccaatattgtccccattgtttcttggcaatccattctctgttctccatcacccgtcaaaggatacaagttccaagtaagaactccagagatggacagtatacctcaaaatgtggtcagaatgcaacacaggagatacatttccgtaacattttgtcactaccccatccaggtagaaaaagaatttggcaatccacttagaaataagacccagctcatttgcaataatatcatattgccttgttctttccacttagaaaatctgtaagatcatatcccaccttctgtaataagagacaaataaatctggcctgttattatttaacatcagtttcatgctagtgtccactcattctttttactgtatttcttaaatggcgtagtttctgattttcttttccttttctttgttttttttttttgagatggagtcttgctctgttgcccagactggagtgcagtggcacaatctcagctcactgtaacctctgcctcccgggttcaagtgcttctcctgcctcagcctcctgctgggattacaggcatgcgccaccacgcccagctcatttttgtattgttttagtagagatggggattcaccatgttggccaggctggtctcaaactcccgacctcaagtgatccgcctgcctcagcctcccaaagtgctgggattacaggcatgagccactgcacctggctagtttctgattttcttacagctcttaaatctaaactcattcatgatgccaggcacaggtatctatttcattatgtctgcaaactgggtcaggctgaagtaactgcacgttgaaagccatattatttcattataaattatctttatttttctccatcacatcatagacaatattgattctttttaaattatgggcataaaaaggttttattatatgtgagtttcattccagaaaagtaatgagagtttttaaatatatacattggttataaaaagggggcactgggtctgaaatgactgcaaacggttggcctagcccaattataatagctaatatttatcacgttcataccatactgtcttcaatacatgtgaacattgttcaaagtaacacacattatatcatttaatcatcacaacacatgaggcaggtactgtatccccatttcacagatcacaaaaccaaaagaacagagagattaagttacttgcccaagatcacaaagctagtaaattgggagccaggattcaaacctgggcaatctgaccaggatccaagctcctaaccactaagcatactgcctgccacatgccacctgtccttcaaggaccaggcctagaagctacctcctccaggaaaacactttttgcatctccagtccaaagaggccttctcccaccctgaactacaacagtacccaccactgctcttaattctttgtcagactcgggtagacttgatggtacccctgctttggaataaaaaaggctcaagttctaatactgactgtgctacttaccagctgagtgacccgaaatgagtaaacctccctaagtttccattttttatctataaaactgaaataatacccacccttcacagggtctatgtgatgattaaatggcacatatgcaaagtatgtggcggacagcaggtactcactaaatgtcagttccctttctctaatcccatactgccctgtattttcttacattattgtcttgttcaatgatttaacattcttttctactcaaatagattcaaacctccctagaggtagagaatgtcttaaacttcttttactttgtttttcgagatagcgtctcactctattgctcaggctggaatgtagcagcacaatcatgcctcactgcggcctcaacctcctgggatcaagagattctcccacctcccacctcagccttccaggtagctggaactacaggcatgcgccaccacacctggctaattttttgcattctttttgtagagacatggtttcaccatgctggctggcctcaaactcctgggctcaagcaatatacctgcctcagcctcccaaagtgctacgattacaggcgtgagccactgcacccagcctgccttatacttctttactatctccacgtaggtgacctcatggcatcttttggtcagcaagtaaatgaaatggagcgagatggcatcacagggtgattcatacctgcaggagctgagtggctgtggccctctgctcagggctctttacaagacactgtttcacaaaatctgtaaagttatctgaccatagctctggttttcggaatgtgggaggaggatttgtaggaatcatgaagattgcctggttagaacaaacaaacaaacaaaaagatctggtaaaataaaagtaatgctccaataaaaaatacatgtggaattacatttgaagcttggtaaatgatttttcacttacccactgagaagctcacccaaattccaacaaaagtctaagcatctgatggttaaagaacctgatatatctccctctctccttttccctctctcatatatgggtcttgttccctaaacctcacaacatcaatcaagcttttttattattattattttggtaaccacagtacattgcctttcaaagtagaaaggcgagacctaagagtatctacatcctaaagataaccttgaccccatagttgtcaagtttccctgcctcttaaaagttattaccacccccagatgtcagcagcaactacacaataaggtcatcaaccagaagtcccaaaaatcacaatggggtcattaacttccaaagtaagctaaatcaacgcatgtgtgagggggaaaaattaaaaattggcccactacgttgcagttacattctactatgtccaaaaataagactattatttattaaatttccaattttaaaaaagccatgttttttgaaaagtaaaacactatacaaataagcagcttaaattatattctttaaatctaaaattgtaactagtaaatctcctcactccttctcccaaaaaagagggaggacttaccttgggaacatgaatttgtgtaagtcttttaataggagaattaattagtcagagaagaggaagagctgtggtaaggaaggatggagaggaccacagagcccctgaggaaggcagggttggcgggggggtgtattacaacagtgctgtgatgaagggttctgggacagttaagcctgggaactgcttagggtgtgagcactggaagagcttcactggagatgcattctatgggcccttaacattctagaaggagacaggggttggagagtacacagcctccagatgaagaggatatggggatctacaaaccaaaacttacaaattcaaaacacctataggggccaggcagaagaaagataaaaaatgaacaaggctgggtttcagtgacatgagttcaaaaatacagtttgctttcttcttaacactattataagaaaaacattagagaaatactgtaataagtggcagctaatacttggtgacacaacagggaatcatggagactgataaagtagagagttcatactctgaaccactactcagctctagtgaatgttgacatgttaaaatgtggttgtctaaactattcaaaatgagtgagtgacagacagagagagagagtagcacaaatcaaactaagcatttctatggcctatgtcctgccagagggctatcaatacacaacctctggaatggagaggggtggaacacacttaaattaattaatgactacaactagagtcagtagaggtgtatcatctatagcgacacttacaaatttacacataattcatttattgtttgcaacttaaacaagtaagccattgaacttttttttttttttttttttttttgagatggagtctcactctctctcccaggctagagtacagtgtcacgatctcagctcactgcaacctctgcctctggggttcaagtgattctcatgcctcagtctcccaagcagctgggattacaggcgcacgccaccacacccagctaatttttgtatttttagtagagacaaggtttcaccatgttggccaggttggtctcaaactcctgacctctggtgatccatccacctcagcctcccaaagtgctgggattacacgtgtgagccacaacacctggcttgaacttcactttttaatgatgatcagtaactaaccaccccactggctttctgtccactttcttaccctcattggatggatatcagcataagggggctttccttcagccatttctatggcagttattcccagggaccagatgtctgctacacagttgtatccaatttcctgaatcacttctggagccatccaaaatggtgttcctatcactgtattccgcttggccatggtatcctaaaatagaaagggagagagactgacactaagcttaaaactactgagatgtccacagaggaagtctacagagaaaaaaagaagaaaaaaaaaaaaactactgagaaaaagaggcttttccaacaataaaaaaatgccttgtacttgaaatacatataaaaaccatactctgagcatgatcaagcaggcatagaagaaattcaaatgacaaagaaacacaaaaagattctcaatcaattattaaaacaaaaactaaaatgactgacaaaaaattttaaattaataattaatgctgataatagcatagaaaatcaggcaccgaaataaaatgttactgtagtataaattggtacattttagtacataagttggcaatatttattcaacttttaaatattcatatcctttgatccaaatctatttcttgaaatctatcttatgttcaagtatctcaaacgatatgcacaaagactgtagaaatgtctgtaatgggggagatgaggaggaaaaggaaacaactcaaatgatcatcaaaagatagtaagttaaatataataaataaccatatactgaaacaccatattaaaaagaaaaaaaaaagaagatatataccttttcctagcatgaaaaaaatgcacaacatacattacaaagcaaaaaaaagttgtacaattatatataatatagccctgtttttgtaaaaggaaaatatatataataatgatgatcataacaataataaaacaataaccaataatatgaaacactgttatatcatagcacaaaaaatctggagtaatacacaccaaaccattaattatatctagtaggcagaatcactaaagatttttactgtctatcctgtatacatctgtaacattctgaaggtttatatgagcatacatgtgcaataaaaaaattttaaacttgatatataaaaaataatatacaaaatatcttagtttatgggctaaagaagaatatgtggatacagtacacattacagcaaataaccacttgcatactttctcaggatggcatggccctactgaaagagaacctccctacagttcctatgctttagcaaaagaaggattttttttttttttttgagaaagagttttgatcttctgcccaggctggagtgaagaggcacaatcttggctcactgcaacctccgcccctggggttcaagcgactctcctgactgagtctcccaagtagcttggattacaggcgcccaccatcatgcccgactaatttttgtatttttagtagagacaaggtctcgccacattggccaggctggtctcaaactcctgacctcaggtgatccacctgcctcggcctcccgaagtgctgggattacaggcatgagccacaatgcccagcaaaagaagaatttttaaacagaactaaatacgaaaaaggacttccgatcatcatcactgatattccttctgaaatgcctgtgatttaggctatgccagtcagaagcaaatgacaggtcatttaaatcaatctcattgtcagtcctatgtaaaaaactaacacaggaactaacttactgcttagtcatttccttagctctgaaacttcaaatttgcaagggtgttttcaaatggtgatagtcaaaattgttttcactggattatttcaattagaaatggttacttggatagctagaaagtttttgaaaattaataagagcaatgagtgtacactaaccccacttagatttgtattataaagttatattagtacaatagcatagcaataaaaaatataaagtccagaagttcactatggcatatgtgtatatgtatgtgtgtgtgtacatatatatcatatatatgtatatataataacctgttatatataccacatatacatatgatttatgattaaaatgtcatttaaaatcagcaagcaaagaatagattatgaaaaaaaaaagcactgggaatctagtcatttgtagaactctacacttaaatgcctaccttatactttcaccaaaataagttcaaataagttgaaattttaaacataaaaaacaaagcccaacgaatactttaaagaagtacattagacagtcaggcacggtggctcatgcctataatcccagcactttgggaggcagaggtgggcagattgcctgagctcaggagttcgaaaccagcctgggaaacatagcgaaatcccgtctctactaaaagtacaaaaaattagccgggtgtggtagcaggtacctgtaatcccagctactcgggaggctgaagcacgagaatcacttgaacctgggaggtgaaggttacagtgagccaagattgcgctactgtcctctagcctaggtgacagagcgagactgtctcaaaaacaaaaaacaaaaaacaaacaaaaaaaaaacagtacattagccaggcatggtggcacatgcctgtagtcctagctacttgggaggctaaggtgggaggatcacttgagcccagaagttcaagattacagtgaactatgatcatgccactgcactccagcctgagcaacagagcaggtgtgctggcttatacctctaatcccaatactttgggaggcagaggcaggagttccggaccagcctgggtaaaatagggagagcctatctctataaaaaatgttaaaattttaactgggcgaagtggcacacacctgtagtcctagctacttgggagcctgaagcaagaggattgcttgagcccaggagtttgacaccacaatgagccatgatcatgccactgtactccagcctgggtgccagggcaagaccttgtctcaaaaaaaaataaaataaaataaaataataaaaaataaaaaaaacatagattaaccattctataatgttaaggagaaaaggattttttaagcatgacatcaaagatagaaaccataagataaaaggtagatggatttttctatataaaatttggaaacttatgtagtatttttttaaaaagccataatcaaaattaaaagacaactagtaaactagaagatatttcagcatatacaaaataggagtaacaattttaacataaatttttttagtttatcttttttaataagatttatttaaaagatgcaacactcagccaggcacaatggctcaaacctgtaatcccagcactttggcacgccaaggggggcagattgcttgagctcaggagtttgagaccagcctggtcaacatggtgaaactatgtctctacaaaaactactaaaaattagctgggggtggtggtgtgcgtctgtagtcccagctacccaagaggccaaaagtgggggtatcacctaagcctggtggttgaggctgcagtgagccgtgattgtgccactgcactccaggctgggtgacagagcaagaccctgtctcccaaaaacaaaaaaaaaaagtacaacattcaattaggaaaactgacacaaaaatgaacatttacaaacgaatttttataaatggccaataattaaatgcaaaaatatgtcaactgctttgagaaatagcagggaagatacaagttgctgcccattcagcattagcaaatatgaggggaaaagagcacatttatatactgaagttggaaactgaaactgttcacttctagaagaaattcagcactatgcatcaaaagcactttgccaatatacattcacatattttctgacctagattccaatgtaaataaattatcctaaggatttactcaaggaaatgctgaaaaatttagttgcaagaatgttaatcacagagtttatgtttatagtggtgggaaaactctaagcaaccttaatgggcacccaacatccaactgtagggaaagagttaaataaatcatgctatatccatacaatgaaatacccatgttgccaccagaaataatattacagagtcttgggtaaagatgacagcttgagcaaatacattttactttcactatctctcaaaactcactcaaaaagatactaaaaggattgttttttaagaataaatctacaagaataaaaaaacaaaggggaaaataactacagccacagaattttaaaagctggagagcagatggcccaatagtaactaactgaacagactatcagatggaatcctcagtcagtcgccaggaaaactaggaaacaacctgattttaacaccaacccctccaaaagacttagaaattggtggcatcaggcagagaaaagaggggtgaaaacggacatccaaataggaagcctgggttgaaagagttaagaagcagctaagcaccctaaaccttcctctcccatcaagcaactagtgggcttccctcgccccaccctggcattagactggaggtgtactctctggggagtgaaaccgaggatctctagactatagagagtgtgggtggtgttgtgaatcaggaacattaaatgagcattaacatgttaacaatccccactgccaccaccaccaccacttcccagaaagctgccaacaaggcctacagcctctagacaagagaccggagaggggcctaaacttagtagtactggaggtttcacaaccaaacagccaagtcagatcatcttgtactacagtttcagtttattttagtgaaggaaaaaaaatctcattttttttaacaaaacaacatacatgttcacagttaatttaaaaaaaaaaaagtccagcaaggtgccaggacacaagataatatacaaaaatcaattgtatgttacactagcaatgaacaatctgaaaataaggcaaatccatttaaaatagtatcaaaaagtacaaactacttaggaatgaatttaaccaaatacatgcaaaacttgtacactgcaaattataaaacattgctaaaagaattaaagaaaatctaaataaatggaaagacagcttatattcatagatcggaagacaatattgccaaaatggcagtattttcaagctgatttacgattcaaaataatgtctaccaaaatcccaacggccttttctgcagaaattgacaagctgatcctaaaatttatgtggaaatacaagggacccagaatagccaaaacaatcttgaaatagaaggacaaagttggaacactcacacttaaccaacttcaaaaattacttcaaacttacagtaatcaagacagcacagaactggtgcaaggacagacatataggtcaatggaatagaattgaaggcatagaaataaactcatacatttcaacaaagaaaaaacagtcttttcaacaaatgttggaacaactacatatcaacatataaaagaatgaaattggatgcctatctcacaccatgaaaactaactcaaaacagattacagatctaaacataagagctagaaccattaaacacttcaaagaaatcataggagtaaatctccatgaccctgcattagctaatgatttcttagatgtgacaccagaagcacaagcaacaaaagaaaaaagaaactggacacgaccaaaatttaaaaattttgtatttcaaaggacaccttcaagacaacccacagaatgagagaaaatatttgcaaatcatgtacataagagacttatatctaaaatatataaagaactcttaattcaacaataacaaggtaaataacccaattaaaaatgggcaaaagatttaaatagacattttcccaaagatacccgaatgtccaataagcagaaaaaatgacagtcgacatcactagtcattagtaaaatgcaaatcaagaccacaaagagatactgcctcatactcactaggatggttataatcaaaaacacaaaaaagaaaatgttggcgaggatgcagagaagttggaattctcatacatcagcagggaacacaaaatggtgagccactttggaaaacagtttggcagttccttaaaaaattaaacacagagttaccatgtgatccagcaactctgtgtatcacatgaaaacaacggttcacataaaaacctgtacacaaatttcacagtagcattattcctaacagccaaaaagcagaaacaatctaaatattcaactaatgaataagtaaacaaaatgtgttacagccacaatggaatattactgagcaataaaaaggaatgaagaattgatgcatgttacaacatggatgaactcaaaaacattatgttaaacaaaagaagccagaaacaaaagggcacattatgtatgattctatttatatgaaatattcagaatatgcaaatctatagtgacagaaagtagattagtggttgtcaagggctgggaagagaatggggactaacagctaaagggtacagtttattttgaggatgatgaaaatgttctggaattagacattggcaatagctgcacaattttgtgaatatactaaacactgaattgtacatattaaaaggggagaaaaattctgccaaggcaggcattatagcaataagaacactgtaagtcattattgggtaatcaatcaattactaaaattagtaaatggaatggatacatatatatatatatatatatatatatatatatatacacacacacatatatatacacacacacatacatacatacacattttttttttgagatggggtctcactctgttgcccaggctggagtgcagagtgcaatggcgcaatctcccaggttcagcctcccaagtagctgagattacaggcgtgcgctaccatgtccggctaatgtttgtatttttagtggagatggggtttcaccatgttggccaggctggtctcgaactcctaacctcaagtgatcctcccaccttagcctcccaaagcgctgggattacaggcataagccactgcacccggccaatattatattattttatagaccatcagagggtgtattttttcaatttggtttcctgactaagactgtggtttaggtaatattgtctggtactgtttacttttgtgttaacaacaaaaccttttggagagcccacaaatcatgatactgaataaggttctgatttattttaaacatcaaagcaatttctgtgctgttacaatacctgaggctccctaacatgtcccaggcagacttataataaaaaaaaaataataaaaaaaaaaccgtacataacaccagttctaaacacacactatatatattcattctaccacccaagaaaaccacttgatatgtaatatttttgcaaattttagagtatacctgcctaaaactatttctatttttctatatatactttcatatatacttatgtagaatcaaataattctagacttcctattttgaaaacaagtttttttttttcttttttcacttccatgcactagttaggcaggagaagaatcaagagactgtatcctggactcaaacgaacagagtgttttcagtacagtaactgccaagtactacctggaagttgaatgagatgatgttatgtcttagtcaaggaaagcagtttggacttaatttttcttcctcttaatttttcttccttttataaatatgttgatgtagtgcactagagtaatctatcatttcttgctttacttttcatctttataaaagttgaacaaagttaagctatgtgacctgaaccccaggaaaagatctaaaataacccactaactagctcttttgtaacctattggcagattctgtgattttttactaatacaattaagtcaagtattatattttaaaaataggtaaataaaaggaactgcttctcaggacagaaatgaaaattatcaatacaagtaatatttttacttactgtaagttgacctgctaccccaaaatctgcaagttttgcatgtccttctgtatttagcaaaatatttcctgccttgatatctcggtgtatttttctcataaaatgaaggtattcaagtcccttaagagttgattgtaatattgtagctatttcatcttctgttaactgaaaaaagaataagaagttcaaattctatcagtttacatcagcgcattagaaaaaggagaaaaaatcagatccaaacctttctttaatataaacagatcttattcaacctgtgaacagcatttgactgcttataccatagatacactgaccactcccaaggctatatttccataccagatctcccctcaatcagatttatgtatctccaactagaatacctagccagcatcataagcataacatgtcaaaatcaaactctatgtctatcaccttacccctctccctctgatccttccaacctactccacttctcccacagtcctccctctctcagtaaaaggaaactttattctttcagttgctctggtcaaaaaccttgaagtcatccttgacttttctctatcttcaaaacactgtatatccaaatacaccctctgtaatcaccatggtccaagtcaccatcgtgtcctgactgcactattctcataatctcccgactggcttctttgcttctgctcttgacactctacaatgtattttccacacagaagctataattaaaatgtaagccagagtcaaaacctaccaatgtcttcctaacccacttaaaataaaagtcagtccttaccaaggctttacatgatctggctctcagctacctctttaacttcatcttttaccactttctaccttgctcaatctgtttcaacaagggcttgcttccttgctgttcctcaaacactctaagcacactcccctttctgggacttttcaactgcctattctcttcatcctgatgtctatccagtatgcttcctcagtttgtaatctgcccaaatatcacctcctcagaaaatggagagggctttcttactccatttctagctcatactctattcccttaaattaccttgtcactgcagtatactaccatctgacatattacccattatttatctatgtatgtgatatcatccctgttagaaacacaagctcctaaaaatgtctgatttgtttacttttgtttccctaataccaataaagccacctggcacacagtaggcactgaaaaaaatatctgttgaaagtgagaatgctagaaactagtatagaatatctgatctggccaatatagactttctgcagacccaacaccagtcctaaacaaactcaatctatcaacaaactgttacatagttccccttctgacaaacaactcagatgtgaaatggagtgtgctctggtgcaaaaactgtaggatttgggactaggaagacgtagcttttactcttggctctactttcatgtgacttaagcaagttactgaccttctcttattctcttagcctgtttcccaatctataaaataggaatataacttttaagagtgtcatgaaaatcaattaatatgtcataatttaacacctttgatattatcaatcaatatttaataagcaccaggtactatgctaataatatgaaaaaaagtcaagcacagtggcacatgcctgtaatctcagcactttgggaggctgaggcggacagatcacttgaggccaggagttcaagaccagcctggccaacatggcaaaaccctgtctctactaaaaatacaaaaattagctgggtgtggtggcaggcacctgtaatccagctactcaggaggctgaagcaggagaatcacttgaacccgggaggcggagattgcagtgagctgagattgtgtgcactccagcctgagtgacacagccagactctgtctcaaaaataaataaataaataaataaaggctaaccgttactaagtgtttaatccatgctaagcactatgtaatctcatttcatccttataacaactaaatgaggtagaggaactattattatcatcatcattttatacataatgaagctgagggcacagacaagttaagtcatttatgccaaaagtcagagagaaatgataaagctttcactaaagtccaggcaaacactactggcaaggtagtaggctagagtctggggtaccttctatagtggaagagaacaaagctcatgacttgacttaccacctctttattctaaccagttaagttaatcagttgaagtagcactgcctaatagaaatataatgggaaccacaaatataatttttaattttctagtagccacattgaaaaaggaaacaagcagacgcagtggctggtgctgtaatcccagctactcaggaggctgaggcaggaggatcacttgagcccagcagttccaacatacagtgacctatgatcacaccactgcactctagcctgggcaacagagcaagactctatctttgaaaaaaaaaaagaaagaattaattttgataatctgctttacttaaccatatttatccaaaatattatcactccaccatgtcatcaatatgaaaaaatcaaagatttttgtttacaatttttatggcaataattcttcaaactctggtgtataatttatatttacagcatatctcagttcagactagccacattttaagtccttaataaccacatgcggctagtggatatcacggtggacagggcagagttataacatttggcaaaataacgtgtagtaattaaaaatcagcacttaggccgggaacggtggctcacgcctgtaatcccagcactttgggaggccgaggcaggcagattgcgaggtcaggaaatcgagaccatcctggctaacacggtgaaaccacgtctctactaaaaatacataacaaattagccaggcgtggtggcgggcgcctgtactagggagtacagctaccagggaggctaaggcaggaaaatggcatgaacctgggaggcggagcttgcactgagccgagttcacaccactgcactccagcctgggcaacagagcaaggagactctgtctcaaaaaaaaaaaaaaaaaaaaaaacaacgacaacaacaaaaaaccagcacttagtaattaagttaaaatttacttaaatataataacctactattacaatggcaaaaaaaaaccaaaagtgccatcaaaattaattttggactagtttaaaatacctgaaataaattgacttaatgctgcatataagaagccctgaaatccaatgtttaattcaataaattattccagttttggaacttctttacatatatcttatgttaggatattattcctaaagaacttgctattcgattaagcaaacacactaattctgaataatgtaaattaagaagatagtatatgaataatccaaaagttataactcagttttaaaacaccctcaccttataatttgtgtagcacctcacaatttacaaagtacttttacatatttaaattaattttcccaactttgcaaatatggaatacagatattattattcttatttttcttattaagacaaaaaaaccacaggctaagattttctctacttctccacttatccacccacaatctacccagaagtcagagttatcttttttattttttgaaacagagtcttgctctgctgcccaggctgcagtgcagtggcgcaatcacagcttacagcagccttaacctcctgggctcaagcaatcctcccacttcaacccccatcacaccccaaaagttagctgggactacaggcgcatgacaccacacttgactaattttgtttttcttttttcttttgtagagacgaggtctcgctatgttgcccaggctggcctcgaactcctggactgaagcaatcctccgcctcagcctccccaagtgctgggattacaggcatgaggtaccacacccagccccagagttatctttctaaaacatacatcagatggctcgctcacttgcttagaatccagcaatggtttcctataatacctgggataaaattcaaactcattcccatgacctgcaatatccaatacaatctagccctgcccacctgtcaaacctcatctcctacagcttctcctttgcctattcccttctagtcatggtagcccttctatcactcagacatgccaaactcattccagcctcaaggtctttgcactggttactgcccacctacaatgttccttcaggactcttagctccttttcgtcatttgagtcttcctgtaaacgtcaccacttctgagtgaccttcctcaactatctactctaaaatagcccaccagtctccacaactttaccatcacttcatcctcattcattttcctcatagtatatatcattattatatcttttctattaatagttactattaatttgcttttgttgccctattccgaagtacactaccatgacagcagagttgtcatctgttttatttactattagatccttcaggcctaaaacagtgttcaagaaatatttactgaacgaatacataaagacattaagtaactgaaccagaactaaaacccatgactcctaggtcttatactgcaaccacagtatcagcaaataatctttcataaggggattattctctgattaacaggaaatacaggaatttaatttgtgaacacgctaggtagaagcagaaacccaaatccaaatccaaatttaaacatttaaaattcattctataactaagatctaacagtcattttcttcccagtaagaaataaccaaagcatgctaaaaatcactggactaaattggtgtcaaaactgccacattgccaggcatgggggggtcatacttgtaatcccagcactttgggaggccgaggtgggaaaattgcttgaggccaggagttcgaaaccagcctgggcaacacagtgagacaccatctccacaaaaaaaaaaaattaaaaaacaaaacaaaacattagctgggcatggtggtacacgcctgtagtcccagctactcaggagcctgaagtgagaggatcactgaagcccaggaggtagagctatgactgtagtgagctatgactgtgccactacactccagcctgggtgacaggggactctggtctcttgaaaaaaaaaaaaaaaaaaagctgtcacacttaggagacataaaagaataaagatggaaaataaccatggaaaaggggaaatctgacagtcgtctctctagtaggagaatgccctgaaaaagaggcagagaaaagaagatggcataagaaactagctcagttgcatgttctagaaggtaaacctaccgttttatttcgtaatcgaatgatatcagatacagaaccagccccacagtactccataacgatccataagtctgtgttcttaaaataactgccataatatttgactacatgagggctagagagagagagacaatacaaattaataaaatggccttcaaatatctcttaattcatgctagcaagtatatacaaattaattcctcatctggaaagatcaattattcatagttaaggataaaatggacaacctcctgataagaatgcaaaatggtatagcttttctggagggtaataaatcacaaaagtataaaaaacttggtgagttctttaaccagcatttctatgtctacaatttatcctcaaaaaagaattataaatgttcaaaaagtaacagttaccatcatagcactattgacaaaagtggaaatttagatatcatctaaatgtccatccaacattagggagtttatttaagaaataatgatacagggccaggtgcagtggctcacacctgtaatcccaacactttgggaggccgatgcgggcggattgcctgagctcaggagttcgtgaccagcctggacaagatggtgaaaccctgtctctactaaaatacaaaaaattagccagccgtggcagtgtgcacctgtagtccctgctactcgggaggctgaggcaggaaaattgtttgaacccaggaggtagaggttgcagcgagccgaaatcgcgccactgcactccagcctgggcgacagagcaagactccatctcaaaaaaaacaaagaatgctatagccgtataataaaatatcatgaatccatgaaaaatgttatagactatgtgataacatgagaagatactgtgtttacacaaacaaacaaacaaaaaagcaggctacaaaacaggaattactgtaaaactccaaagtgatttggaagaatatgtgtatcaagcagtgtttaagaatgatgatttcagccaggcgcagtggctcacatctgtaatcccagcactttgggaggccgaggtgggcggatcccgaggtcaggagatcgagaccatcctggctaacatggtgaaaccccgtctctactaaaaatacaaaaaaattagcctggcgtggtggcaggccctgtagtcccaactactcaggaggctgaggcaggagaatggcatgaacccaggagccggagcttgcagtgagtcgagatcgcgccactgcactccagcctgggcaacagagtgaggagactccgtctcaaaaaaaagaaaaaatgatgatttctccaaagggaaaagtgattttcttttcttttcatttgaatttttctaagaagtcatatgtactttgtaataaaaacatacacatactacaatctattataaagaaaaaatgttcaggatcaaacctggaattttaggtctcaagctggaagagagataccaaacaagaaattcagagaaaaatcaaatatcctattaaaataaaataatgtgccctctgagagctgccagctttaactggctagattgttatcatggccaaatgaagtttcctaacaactgatgttaaaaccaaattggcttcattaactcagaactcttacaatttcctcttcaaaccttaggaaacatgccagtgacaaggacagcaaaacacacacacacattaaatattaatgaaaaaagtgtctaaggtaaatatcaacacatttactctccctgtaatacagtactgacaggagttaaatactgtaggccattactatcaagtatttactactggaatatgttctctatagacttgcactgttggctagattctcctctacatatatatatacttagcctgtccaattagtctataaactcccaaagcacaaggactctgctctgtatttcactgtattccttacagtgcttagcacagagtagacgcttgaaaatatctcttctttaattaaagacatttccatactctgtttggaacacagctcccgcacagtctatcgaaagtgacaaagtcccaatttgccaaatggaaagaacttccaaaatgtatctgaaaaaggagcaaatggaaaactgccaccttcatctggtcaatccaatcaagaaaaatggggattttatctagtagacagtaatcacaaaaatagaagggaaaaaaaaagaagggagagaaaaaagaaaggactacattcccaagtctgtgagactgaaaggcttctggactaattttttggtaggtagccccacctaaaccctaatgtagaagttttgcaaacagcaggtactaagttgatctgctgaccaaaaagccttcagaagaatgaatgcagcttcaactgagagaatttctcacccatcttcagctccctagagctggcattgcccctaactttgtgtttgtctctaatctaaatagtgctggggaagcctgctctatcagtgaccaacccatgttgtcatggaatttcagagcaaaccacgtggttttctgtggttgtcttttggtctgacttcctgcttacaacatttgacaaatcttagttcctcaaaaataaatacgtaggtactctcagctagaataattttttttaatgtgaaggaacaaacagtagtatatacataactactctttttttatagatttacctgatattctaaggtttctagaactaaaaaacatttgaattatctgttcttggctatctctgcagaaatgttttctcaataggaagtaaaaaagatcattatcacacacacaaaaaaaagcaagcaccaccttctgcctcttcttcctagtttctaaaagggctcactgaagaaaagaaaaaagccaggtatggtggctcactcctgtaatcccagtactttgggacttggccgaggcaggcagatcatttatggtcaggaatttgagatcagcctgacgaatatggtgaaattccatctctactaaaaatacaaaaatattagctgggcgtagtggcacatgcctgtagtcccagctactcgggaggctgaggcacaagaatcacttgaacctgggaggtggaggttgcaatgagccgagattgcaccactgcaccccagcctgggcgacagagcgagactttgtctcagaaaaaaaaaaaaagaaaaattgaaaaaaaaaaacaaaacaccatgcataaaaattacggaggtttagctacaaaaacaaccattatcatcatatttttttctgaaaagaaaatgcacagtgattccatcgaattctcccttctgcaaaatatctaagtaaatgtgtctctaggtatcaaactctacacaatcatagctaattcaaaaccacattctccccaaaggaagcccacatgcctttacctgtcacattgctgcattatagagatttctttgattatctcctggaggtctgattccacaggaacttgcttaatagcaacaatctggccggtctctttatgaatagctttgtatacgctgccataggacctatacatttgggagaagaagaacatttataaagtcaaagcaagccaagatataagaagtggtaaaacacaagcaactgatagttctaacatatatccctaagtgcctaatacatatacacttgcaaaactaagatagctaaaatacttttggggaaaaaactgtcaagagaactacaacaaaatggcatcttgaaagcttcacattcaaaactgtaatgaatgtattcttatgagatggtaatatagtagctgccatgcactgcatgcctgctatctgctagagactgtacaccatctcaattcattcctacaaaaaatgaagatgagatgactatccctattttacaggtaaatgtaaaaaggttcaaaggggtttatgatttgcccaaggtcacataagttatcagtccaggatttgaaaccagttgtgttatcagtccaggatttgaacccgggtgtgtctgaaaacaaagcttacgttgtctccccatctatactggggtacaatatggaagtggcagtctttgttttattgtattcactctagtaccacaagatctttctgtccttgctcctcttacttacaataatacttaaaatattatggaaactaattaaaatctaagcctgtttaatattagtatcaggtaaacacagcacacacactctttgcttcctactccatcttcccttaacagcttaatatcaaaataaagtttgtgtatctagtcaatttggaggctacagatccactagattttgaaagtaaagaagctggatttgagtcctaccaacactacatttagctatcatttacaccttattaaccttgttgtacctgaattttctcatctgtaaaatgacaataatacaaactaccttacaagatgtgatggtatctcatttgtgatggtcaaatgagataccatcatcactttatacagataacattttcattggaatcctgggcagctgtcagtgaaataatactgagtaaactgtctttcatatttcccaacacatctgtatcttcacactgtcttggtgaaaaaaaaaatcaaaatagcagtgccacctactatgtcaaagtacaatactctaactgccaaatagatgctcatgaactgtttcaatgtgaaagtaacataaaactttttaagtctatgcagagcacataaaaatatttccattccattagaagctgtcatacttgcaaaactagcataatcatccttaaatattacaccaaatactttttgccagagagaggcaactgttgagcatgtgtcccttcttccttgctaaaataacttcctaatttgttacagtggtgatgtgcttcgtcccaggagatataccatggtagtccaagccactcacagaattcctattcccttctgccagtgactgaactagtggcaaacatgtcgcccagttctggccactgaaatttgaagataattctgctgaaaggtttctgggaaagactttcttccctggtaggagacaagcacacaagaaggcccatttccacctgccacttcccttctttctttggttactgccatgtgagggatgatgcttgaaactaatgcagccatttgagactacgagaattacccagatgtcaaaccattgtcaagccaattaacggcttctcgaatctcacacccccagatgtattatttagttcttaatgtctttattggttagccactgtttgttgggtattgttacttccatccaaaggcattcttgataaattagctcctgtatgtctgaaactgtctttatttcacctccactctagaatgatagtttggttggataccggattgacaacagctttccctcagcactgttgttgcagtgttccaacatcgactgtggctgagaagtcagcttttatcagattatcattttccatgggtaatctccccatagtttttaaggtttcctttgtccttaacagtctactattctactgtaatgtaactaggagttgatctggcacttcataaacttcttcaatctgagggctcgtgtctttcctcaagaatgaaaaactctcaggattattatgtgattatttcctctaccacttctaggatcttcttttagaattcctaccaaaactgtattagacctcctcaatctatgttgtcttcctggtttccaacactgtatttctgcatgttgtgatcagtctcatttctatctttcaattcacaaattctcctttcagtttgtctagtttactgtttatccaatttattgggcttttaaaacttcaattgttgtagttttcattgtcaagattcccaactttttatctgcctttgggcaaatatgttaataatcatgtcaataatctgatgtccttttaaaaatgttatctcctccttgatctttttgaaaattgtaattatattaaattgtttttgagattgcttcattatttctttttccttcagtgtgaattctcccattctgctgattatctcatggcagtagatttccttgcatggatttcattttctcttgaatgattttcctctataccacactcactgtcgatgatttcatggttttctcagtacagtagtctgggatatacaacttaaaccaggtcttatattcagagtttggggtttttgcccttcaagataccatacttaaatacaatccaagctcagttcctattatcgaaccagtatatccattttttccctaggccacaggcaaatgacactttctggttgtggtcaggcaaatttatttcagctttagttcacagatggagagccgagttccagcccccaacttcatgcaggaagctcaaatgcaatctcctgacaaggataaggcatgctttagtctccgctgattatttagatttctttcctatcccttgtccatagctgtctatatatccttatatttaaaataattttcactcattattcttatatattagaaagttctcttcatacactcactcagcaatcttgaccagaacactcttcatacctccctatgcatcctgatagcaaggaaaactccaatagctcacatgaagttaagattcctgattccatatactgcatctacagtaatctgaaggcagggatagggggtggttagaagatttcagcaatcatactcacaagcaagtcccttaaaacttgattccctacaacaaaatgagatgattcaatgaattacaactgacagcagagaatggagaagtaggtgttttacataagccatgcaaggcaaggatctatgtagaaaaatggaaataccacagtatctgaggccaaattaatcagatacaagtcttaacaatagcactcattttttatgaaaccatgggcaagatgcttttgttatcattctatgataaaaattcaaatgagtcaatgtgtacaactttaagtagaagaaaaaaggtgctaggctccacttgaaaacacttcccaagtgctctccactcatcctggtctggagctttggctctactctgccacagatccatatgatcctcataacacagaatgattgcagcctccagaatccaacagtttttttagccatagctcatttcacaagatacaagtcagtgagagttcacaaaccattcatcctcccgaacaatttaagaatagcattggccaggcgtggtggctcacatctgtaattccagcaatttgggaggctgaggcaggcagatcacaagatcacgagatcaagaccatcctggccaatatggtgaaaccccatctctactaaaatacaaaaaataagtcgggcgtggtggtgtgtgcctatagtcccagctactcaggaggctgaggcaggggaatcgcttgaacctgggaggcggaggttgcagtgagccgagattgtgacattgcactccagcctggtgacagagcaagacttaatctcaaaaaaaaagaatagcattgtgtcacatgtttggaaaagaagtgcagtgaaggtcttccttcaaaatattcctagttaaatgaggcttgcttaggttcattcagtcagaataacagaaatccaagaaataccagaaatctggtattatttagaagaacaataaggtgatagtatgggaagaaagatctgaagctttgttttctccctggtgatatcttcatagggaaatttccacattccttgcagaagacatccatagatctaaaacgcaatttgtccaggtgcagtggttcacgtctctaatcctagcactttgggaggctgaggcaggaggatcacttaaggccaagagttcaagaccagcctgggcaacacagtgagacctcgtctctacaaaaataaataaacaaacaaataaataaaatacaatttaaaaaatcataattagcttattttttgtttacattatatttctgatatattctctgtctatagtcttcctttgacattccacaaacccaatcagctcagagctacctataacaacacctaaaaatactttaagacttgacatgatgaggtcttgaaaatgcttcagttgatacatttaaaatagaatagcaatagttgccacttactgaacatttattattgtgataagcactatactttaccccaattacctcaggtaataacacaactctatgaattgatatattattatcccaactttacagatgaggattgtgagcctccaaaatagtaagcaatttgcttaagcccacttgtctattatgaccagtaaacagtagagcaaggattttaacccaggtcagcctcacattgtagtagtaagagcaaactgtattagaaatgagagaaataagttacatagtcaattatgcctatcagtcttgaacttattctaagtataacttatgagcattgttagattaaaggtcacagccttgctgccttagggaaaatagcaaggatggcaagctaaagctgaaaatggcaggcaacagatgtagagggactgtcatttccccatacctttaatgatgccagtcaactggcagtcttcagattcatcttggacttgtcttttcacagcacagctggtgtgtcatttttacttcccttctctgcttgatttcttgctggattccaaagagtatttttccaacttacaaaaagacgatgactcatgttttttacaaggaggtaaatcataaaaaaaccatttcatgtaatccaggattgggtttaacgttgtaaatctgtctcctaacataaaaaatactaaacccaaaaaataatctaatgacataaaggaaattattttaaagagcatatagtcatcagtcagtagttgtttttacaagttagtatgtcaggtcttcccttgatccagaaatactcccaagggattaaaaatacagacacacacacacacaaacacgagtgtgcgctcgcacacacatagcctgtctctgaaagacacacaagaagccgctacccttggtgattctgggtggctaagagacagagagaggtaggaggcagtttttttttttttttattgtatgcgtcttaatatttttttaaattttgaatcatatgattgtatcgcctattcaaaaattaacaagaaaaacttaagaaatggtgtcattaacattttaatttcctggtcattacagaagaaggaataaatacacaggattgaattaaaatgatatataaaagtataaaaattatgtaaacttaattgtatcatgaaagtcaatgatggtcactgcacattactaatatcatttcatcagtattttataaacgcattaacaaatctgtgtttcaggaaatccactggctcccaacccaggattgtggatctcctaagtagctgtgaaggtggtgatagtgcttaatttatttactatatttcacaaaggtgcaaatattaaaatactaaattacattgattttcattgaaacagttattgcataccaatcagaaattatgaacagcaaattaaaaagtttcttatagaattttaatctaattagtgctatctgttaagtagataaaatcatacagatcctacaaaagagaaaacaatagatattcttcgtgttaaaaagaccaggaatcactaaatctgtctataatagggattggagtaaagcgaagaaggacatcacaagctgtaaatttaccttccaccccacctagaacaatgctgaaaggttcatatccttctgcttcttctggggcaggaaaaagactgggacccaatgacctacctatagtttctttacactcacccttctccaagtttctctaagacatcaaatacttcttctggttgtttggttaaactatcttcatccaactttttcagctgcctgtgaataaagaaatataaacacaaaatacattttatttgctaggaactagaacataaaatatatcttttttttataattagcatctcaggaacttctctatacagacttcactagttaagactgttttaagaaacaaggtttcttgggaggccgatacaggcagatcacgagatcaggagatcgagaccatcctggctaacatggtgaaaccccgtctccactaaaaatacaaaaaaattagctgggcgtggtaacgcatgcctgtaatcccagctactcaggacgctgaagcataagaatggcgtgaacccaggaggcagagtttgcagtgaaccgaaattgcgccactacgctcaagcttgggtgacagagagagactgtctcaaaaaaaaaaaaaaaaaaaaaaaaagtcatgtggctgaaatgctgtagattcaagcattcgatgtatccttcaaaatctatttaaatcttgagatttcatgaattaaaatgatgtaattatctcttcagaaaaggtgtttaatgtaaggtaactatgaattgaaacataactatgaattggactgcagactaaggaagacacgggaaacctttgctcttccattagcaagttttttgtaagtttgtcaaaacacataaattctgtaggtatcacagaaacagaaagtggaaagtgtacatttagatatgatcaaaagtgaaaaatcactaggcagctgtgagtttcagatattctcacaaagaccttcctatgagtagatacatacctttgactagtcccaaaaatcaaaggtacttggctgctcacaatttccagataattcagatttctgactatgctagacaatcataacaaacatgggaggttataaattaacatttttttaaaactctgagatctctgaaaattactaatgagcttaaagaaggaacttgccaaggaatatgtgtgtgtgtgtgtgtgtgtgtgtgtgtgtgtgtgtgtgtgtagtctacacaatggcttcctgaaactacaaagaacaacaaagaatagagagctgaggaaacggtgaaatatggaagtagtcacactggagacctctttgtagaaaaaaaaaggtttagactagctggataatatcaattattacaacaaaagacttaaatacacacacatacacacacacacacacacacacaaatgtgtaccttcctaaataaaacagattaaaattagaagacaaaaaataaaacaaaccaacaaaaaccctgaccacatcaagtgtatctaccaataaacactgatctcagaaggacaatcttatagtttatgaatatcaaggactataaactagagaaatggagaactgctccaagtcaaaactgccttaacttgatatcaacagaacaaaatgatcacagtgacctttgaaaatcaaaaggtcctaaaaattaaataccaatgacatcataaaaactcctaccttcaaaatgaaaagggatgaagtgaaactcctcttaaacttcagaactgaaacttctataaactcagaagtcagaacgaacatctcatatgccagggtttttttggtaaagtcctgaattgtaattgtataaacattggacaatacctcacttctcaagtataatcaaagttgtataaacagcttatacaaaggaagatcaagtatgtttctttgaagtgttgactctctgtggtttacaaaatgcaaaagtcactatttcaactacttcagggaccacagcataacaaaggaaattgccactgccttgagatagacagctgcaaacctctgataatactttgacaaactttttttttctttttttttaattattattatactttaagttttagggtacatgtgcacaatgtgcaggttagttacatatgtatacatgtgccatgctggtgtgctgcacccattaactcgtcatttagcatatgacggctcgaatacatctttgaaacaatctaagtgcttttttgtttgtttttgatccggggctattaaaaacaacttgaacttaaggcgctattacatctctggtgcctgataaccaagaggtggtcaaaatatatttgtgaaatggattcacaaatgtaatgatgggaatcacgaatttcatcagcaatctttgaattatcacaataaaacagaatttcacctaagaagtattactgaattatcaacatttctataaaaatattttgataagtgattcataataatattttataccatgactcttcacagaaaaaacactattaccaaaacagcctgactctgataatacagttctcttatctgggacttccccaggttccagacggtttcagcacttgctcataaatgaacaagcctgatcaacagagcatccatggaccaaatactggtggatgctcctctcctaagtcagatggccatgtggatggccagcatcccaggaatgcactctacgccttccactataacattaatctaatggcaactcattttttaaaattattaactcctatatgagacaccaatctgtcatcacttaatcacacacacacacaaatgtcaaactcacgaacacaaagggcatttcctgcactggggttattggaaacacatgccatctgaatttctgaaaagacacctgtatctttccaaacacaagtaatggtgtctatgaagtagtcacttacaggtctggctaattctcaaagctttctcccatttcagaactcccataaagttcattttatgtgtaactatttctttttccacacagaatttgatatggattacaacaactatacatgataaatggacaaaatcttacataataaaactgtgtccccagcttaccccaattcatatgctgaagtcctaatacccaccacctaagaatgtgactgtatttggagacaaggcctttaaagaggtaattaagataaaatgaggtcatatgggcatgccctaatccagtatgactggtgtccttataagaggagattaggacactgacaggtacagaaggaagaacatggagacacagggagatggccatctacgagtcaagcaaaggcgtcaaaagaaacaactctgacaatgccttgatttcagatctctagccttcagaacagtgagagaataaatttacgttgcttaaaccacccactccatgacactttgtcttgtcctgataaactgatacacgtgataataaaattgatctgcttcaaattaggcaatctactagttacaatgagctgggaatcaccagccacttcagaacccagtcctgcaatgctcttctcttgtgcttttaatacattttttaaaatccaaaaggtacaggaatgagcatgccaagaaactttagtcctttgctcaagattatgtaagacaaggcaaagggggaaacaaaactcagattcctaatcctcttttcaattaaaccaaggcctcggagaaagaaaccaagaagaacgaacgaacatagttcagaaagaaacataactagtgtgcattcataattggatcactatggtactatagtaaatatctgctaacatacacagagacctgtgaaacaggggtacttttagagaggcatcagagtgaggcagttaagagcatggccgggcccggtggctcacgcctgtaatcccaccactttgagaagccaaggtgggcggatcacgaggtcaggagatagagaccatcctggctaacacggtgaaaccccgtctctactaaaactacaaaaaattagccaggcgtggtggcacgcacctgtggtcccagttacacaggaggctgaggcaggagaatcgcttgaacccagaaggcggaagtagcagtgagccgagattgcgccactgcacttcagactgggcgacagagtgagactccgtctcaaaaaaaaaaaaagaacatggactttggaccagaccccatagacattaaaatcctagctctgtctcttacttgctatgacttctcccagcaaatcactaccctctgtatctcagttttatcatctgtaaaacagacatatagggatatctaccacacaggattgttgtgaggttcaaatgagttcaaatgaggtttttatggttcaaaaatggtcaaatatcagcaatttcatatgcttcagcaggacacatggaaagcacttagaacagtgcctggcacccggtaagtgcaatatgagtgtaataatcattactattacagtctcagcacactacgctagggtgaatccaaagcccatcccaaccacctatttgccttctgcaatgtttgtgcacctcaaacatccccaagctcaaacaacccctaagagtgctgcccaggcagtcaatcccttctcttcacctcttggttgccctgcacttccacaccctgaacacttccttctttagagctcattctgctgcaggaagtcagacgtctctgtgaaatagaagtaaccacactgaacctcagagaagcatgactccttcggtctctagtccctacttttctccagatgtggtagagtggcaaaagacccgggatgtccacaagggaaatccaggagttgagattttctaggatcagccaccatcctgatcttgaactaaagcaattccaggtaccactaggatttggtgctgatattcacaaaacaactgaggcctgaaaagggcacagactggcagggttcagtgacccggagtaaagaaggaaacacttcccaactactctggacctcagtctccccatctcgaaaatatcctcttatttccttacctacctcccaatgtcaggttctgaagagctgaggaggatgtgaagaccattaggaagacactgaacatcagtaataaaagatgccatcctacagtggggacaccaccaacagcatcctctgaaatgctaccctccaccatcccctcccttgctagaccctcaacctttcctcgcatgctttcagccttaggcgcaaagcttttcccctccacagatccccccaccgcacccctcaagtgggacttcagacccttagaaagtccacccggccttcctcttggccagttctcgatccacccccttaaagagatccctcacagattctcaccctgcttcagcattcgcccccacctccgtgagtccctgcttggatagcgttcccccgagtggcccggcctcagcaggtactctccctaacttgtccccacgttcctcagcacagtctcaccacagcgagtgctccctctaaccggtcccaagtctaacctccttagcagatgctcccctcagccggaccctcacccaccagacgtcccccccctcactcagcaggtgccccatcggctgggtcgcttagctccggggactcccacacaggtgtatcccctcaaccagttcccgccttttcttcccctgaccccatgcccgtcctcttagccagtggcccctcaccggcgcggcgggttcctcagctgtaccgtctccatggcgctgccagcagccgcccagacccgctcactgctccatcctcccgcggacctcctgagcccgccccgcagaccctcccacacttccgctttccgcccctaccggaagcggcgcgcggcgcgggagcggggcggagccacggccctgatcacgtggttcgggcgtgagtcttgtggcgcggtggggcgcggacccggaaccgccaagtggtgaaggcgcctccaggcggtgcccgctggtctctagagtgtcagtggcgctgtcttcctgcgttaccggagcgcacaaaatactcggtccccaggccgagaacgcacctctacctgggtcctgggtcccatttcacagactgagatgcgtgaagcgcctcctttagaagagctgacaattcttagcaaaccaagttttgcgtgattttggggaggcggcgctgccccaggaacgcctggaggtatttgtggttttctgccgcttacctggttgaactctggtcccaacgggccccctgcacattttctcctacaatgcatcaacgcgcaaattgccccactgtctttcttaaaggcctcccctttaagtcagtttgcagacataaaaataagcaacattaattaagcatttgccgtgtacttgtcttcatatattatctcatttaatcccctgtgtcaagccgataaggtcatccccgtttttatttatttaatgatttaacacagtccctaaacgttttcagtgctttacctcatttaatactcctaacaacctagacggtattattattattcctacttcataaggccagagaggtgaagtatctagcccaaggtcacatagcttagagtataggtttggggatttaaatccagtttggtctgatttcagggcctgcaccaccaaactggacagccatgggtgtgtaacctctttttgggcctgagaaacagacctttctctccactcagagctccggcttcagctattgtgcttccgaatgccactaccatcagtaagtattaggaaaatggcagattctacccaattgacccatggggaaagttataggagaaaacttaaccagagcaacctctcactgtttttaattgccttgcttttcccaaggatatgccatctacagaacttaacacctgagcacccacccttcagggccacccatgggcccaaaacgggataaaggagccattccctgacataggaggaaaacatttgctgagaagctactgtgtgccagacacaatcttggactttcacttaatcctcaaaacagccctaggaagaagtacctaccgttaacagataagaaagctgagacccacggtttacacagctaaggagagcaaaggttttaacccaggactgtcctgactccacaacatcaaagttgttgttttgtttttggtgttttgtagaaacaggatctccctattattacccaggctggtctcaaactcctgggctgcagcagtcctcccacctcggcctcccagagtgctgggattacaggcaagagccaccacacctggctgatgaataggaattgggtaaacatttttgaaaattaaataccaaattaccattacacaatgccaaacagacctcctttgtccccttcccaggatttttccagaagatggactcacattatgatggccccctttttccgcagagtgttcccaatgaaaatttctgaaatgatgggaatgttctaaatatgtgctgtccgaaatagtaaccattagccacatatggctattgagcactttaaatgtggctagcataactgaaaggccacatttttatttaaatttaaatttaaatagcaaaccgtggctaatcataataatagcttaagagagaaatggtgagcagggttactgggagaggtattttcctataagctctggatatacagttgacctgggaacaacaagggtttgagctgcatgggtccaccaatacaacccttgttttgttttgttttgttttcaataaatacagtcagccctctctatcagagggttccacatccacaatgaaacatggttggaaaatacagtatgggatgtgaaacctgtgtatagggtgggctgacttttcgtttccataggttctgcagggtcaactatagtacatgagtatactcacattttagtatcctaatagatcctcaaaccaacacctggcagaaaatggggaacaattgcataacagtattcaagggactgggtatgatggcttgcacctgtaatcccagcacttttggaggccaaggcagaacaggagttcgagaccagcctgggcaatatggtgaaaccccttttctacaaaaaacttagccaagcatggcatatttgtgtaatgccatttgcatgacccacatggtcaccctggaccccgtggatcaggccctgcctggtgccaccaccgccacttctgtgccaggcccccagtgtgatgcaagttgcatgatgctctttgctgtagtgccttttaatggcatagctttggcaggtttggagatgttcagaataggcaaatcctgtggtggatttgtggttgtctaaggccctggtggaagggagcataggtgaattggaggggatgattaaaaggtgtgagatttcattttggggtgatgaaaatgttctaaaattggttgtagtaatggttatacaactctgaatatactaaaaggcattgaattgtacactttcaatatgtgagttatatctcaataaagctattttacaaaaaaagacacctcttcccagaagacttctctgttcccttgtccctcccctgaccctctcatctgtccctccttcaaattatttcagtactgtttttatcagtcctggcatttataggaagcactgcaggaagggatttccaggtattgactgctgtgtaagaaaccaccccaaagtttataggcatagaacaacagtctttttttcttctcagaaatctacaatttgagcatggctcagcaggaaggctcatctctgtttatggtgtcaatcaggatcaatcagccctgtccaaaaggcatttcacacagctgacaggttggtgctagctgttggctggaagctcacttgggtctgaaggctaggggcgtctccatttttcttgagcttcctcacaaaataaagcctgggttctaaagcatgttcccgagggagagccaagtgggatgctgcagtgccttttagtggaagatacttaatgtcattaccactgtggaggggggccacaaaggcccacccagtttcaaggagaagggatgcagactccacctcctcatagggcagtggcaagggtctggaagagcttggggaaccagaaatattattggggccatttttggaaaataaaatttgccacagctacacttatccgataaaccactcaggaaatattcagctgcaagcaagtgaaaacatctaaatgttggcttaaagcaccatggcatttactgtttgttttgagacagagtctcgccgtattgcccaggatggaccacagcagcccagtgatctgggctcactggattcaagcaattctcctgcctcagcctcctgagtagctgggattacaggcgcatgccaccacgcccagctactgtttgtatttttagtagagatggggtttcaccatgttggccaggttggtctcaaactcctgacttcaagtgatccgtccacctcggcctcccaaagagctgggattacagctgtgagccaccacaccttgcctttattgtttattaataagctaataagtcagcagttgattcaatgactcagcaatatctatttcattttttcccctcccatcctactcagcatgttggcttttcatacttgtgtttattgcctcatggttgcaaaatgactgccacacctccaggtatcatatccttaacccagcactacccaaagcagaaaaagagcaagaatggctacttgacccagtacctctctgttatggggagggaaacctttcccataaacactcagcagactcttttttttttttttttttttttttgagacggagtgttgctctgtcgcccaggctggagtgcagcagtgcaatctcagctcactgcaacctccacctcccgggttcaagctattctcctgcctcagcctcctgagtagctgggactacaggtgcgtgccaccaccccagctaattttttgtattattagtagagatggggtttcactgtgttagccaggatggtctcgatttcctgccttgtgatccacccgcctcggcctcccaaagtgctaggactacagatgtgagccactgcgaccagcctcagactcccttttatctcattgcccagatcagcatcacatgtgcatcccttgatgaatcactggcaagagaaaatgacatttttctaattggcttagagcaatcctgattcacttccccaggctgggagagtctcaggcaaaattcaggctcctggaagcaaagatggaagtcactgagtagccagccagcagcatgggcctcatctggttttcccaccacagtcagtgttcatccttggtcggggcagagggcaaggggaagcatttcagatggaacagccatccagccctcagaaagcttatagtctggtggagttaagtgtatgcagatcattataactgaattcctgaaggtagagactagatctttatcaatcaatgacttttattggatgccagaccctattagggtcttggataaacaaagataaaaaggacccacttcctgccattaaagacctcgcagtgtttaaggaaaactacaaactggcaatcaaagggtgactaatgcaaagttagggataaagctagagaccaatagggagcaaagggagcatagtggggggtggggagggggctggaagcaggaaaggctttcagagaagatgatgtttgaatggaatgttataagttaattcaggattaggcaggagaaaaagtatttagaaaaaaaaatccaggagaaggagataacaagcaaaggctaggaagcaagaatttagtgtgtgtagatagcaatgcgtgggacatagagtcgtcagatgaggctggagataaattgaagtcacactctgtgaaagatcttcatccattctgaaagctgatcatacgaattgggtcattcttgtcatatccaactaagacagaattgaaaagccaggggaacaaatactcagggcatataacattgctccaaaaaagtaattttttgcaagcctggctgctaaaactgcctgctgtaacctaaaaccagttttatctaatagctactgaaacagcctgctacaattctgagttttatccaccactatcacttaccaatcaaagcttgccagctccccaagaagctgataaacccccactttactagtgcctgtaaacttccttgaagagcaatatgtaacatttctgttttataaaaatctccaaaccttctctttgttcttctgacataccaaagacaacctggtctgtgtgtaagccctgaattgcaattcttgattgccaaataaaatatttaaactttagagattcatctctatatgttgactttgacaccatcaatccacctgtgcattaatttattaaataaatatctatagagcactaggtaccaggtactttctagccttggaacctttgcacttaccatccctctggctggaacagcattccctaaatcttgtctggtctcagctcaactattaccccctgagaaaggccttccttcatccccttatttaaaatagcccacacgtggtcactttccattgcattatcctgttttgttttccttacagcactaatcacatgaaatgagagtcttcgtttgcttatcagttaattgcctgtggggaccccactaggacataatctccctgatagcggggccagcctccttccctgcgtcatccacggcgttctagcaactcagggagcccagagcatgctgccgccccgcgtgcaagggagcctaagttccaaaccgagcacgcgcagagggcgggacgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggtacgaccccggcccccatctcacctccgggcctgctcctccaactcccgcaaccaccgcccgggcctcgcgcggcggccagcagtcctgcccggccctcccacccttccagccccttccgactccggcatcctaccagaaacttcctcggccctttctttccacctgcttgttaactgccctgttggcccccatcctaagttatttaggcctcgttctgagccctgagaagaaagctaaaccctcctcccccgcagcaattcatttttcagttagtatttgttgagtagctgttatataccgcctgtgtaacaagacacaaaaagtcccttctctcaaggacagcgcattcttgtgggggcggtggggaggacgtgagtcttaagcgagtcagtaagtaaacgagacctgtgggataatcagggttaggaagaagacaaatagggtgatgtgatagagttgactggagtgggagatcaagggcaacatctgtaaagaagtgatatttgaggtgatgtctaaatgatgagaagccaagcgcacaaggttttcggtcctgaagtgaactgcaatgagaaaggccccccctccaagacgatataaacatggtgtgtttcaggggtcaaagcatagtgagccagggcagggaataggaagacatgaggtcagttaggaaggcagacccttatttattgtggaggtgttgtaaactctgctaaggagttcggatttcatgccaaactggaagcttggcatgaaagctgctggatgggaagctactggagagtttgaaacagaagaatagcatattcttaccagttctcccagcgtccagctttcgtcagcataccgcagacctttgcccaaagccccttctccagggtgacttaatcagaaaccctcattggttaaagccttgacttttgaaaggagccttggatcctggtttctgtgagtcaccgttcagtacctatttccctttgccgccttcctttttttccttttcttggctagcatctcttgagtgatttaccatgtgctagacattttagacacgatctcctttgatctttattatggccctgtggataaaatgcttagaaaggaggagtccaagagagttaaattggctccctcggggttacatagtgaagacatggaagagccacgatttgaatatggatctgtttgactttgatgctaagtccaaatttttaatcattttgctagacctctcctcacatcctctccagatttcattctttttttttttttttttgtctgcactttttgcagtttcaagccactcctttgcccccttctttgttctagaaaactctcctttaggcccacttcctcatggcagccttacttgatgaagttgctgaagaagctgaggtattgatgttgctgccattttcattcatctcaccccagctggtctggaaaagcttgtacatttgtatgggttaattctgggtccatagaaaagctagcctggtatctagatttagcaaggaccggagtttggttctgctgctgctacagatttcctaggtaattttgggcaagtctcttgatttatctgatcagtcttcttgatcacgaagagagctcagggaacaggctaacacaatgaacccttccagcaagtctatgaagtgatatcctcatgtggtaggtgggcacgcatgatcagagggatggagtgacttgtccggatcgcagggttgatgccctttccaccgcaccactgctgtttctgagcaaccgtactctggtgactcaagatggattacaggttttgggtacttagctccttaagggcaaggatgtattttactagtctttgtactttccgtctctgggcctggcaaaacaagaggggaaaacgcttgttattgttggtattgaatgaaagatatcaaatatcaacatggcaacaggatactgagtgaaaaaagtaagttgcagaaggataggcaatatgatgcctcttaggaaatgctttaatagacataaaatggtatctttcctgttaacacacacacacacacacacatatatatacatatacatatatatacatgtacatgtatacatatatacatatacatatatacatatatatgtaaatgtagaacatgcttgaaaatgttacataccaacttcaggattgtactggcctctgtgagtctggggagggagcacagggataaggatggggatggctggagttttagcttatcaaaaaaatttttaagggttgggtgccatagctcatgcctataatcccaacactttgggaggccaaagcgggaggatcacttgaggctaggcattcaagaccaacctgggcaacacagtgggactctgtctctacaaaaactttaaaaattaactgggcttgggggtacacacctgtagtcctatctgcttggtaggctgagctgggaagatcacttgagcccaagagtttgaggctgcagtgagctatgattgtgctactacacttcagcctgggcaacagagggagacgctgtctctaaaaattaaaaaagttgggaactaatataacgtgctaaatctagtggtggattctgagataatggtcttctgtatgtttcaaaattttcaaaaagagaccctgttttcaattctttttaaaataatggccgacactagtgggtatgaagtggttgaaaattatctttaaaaataaagatcattgttggttgggcacggtggctcacgtctgtaatcccagtactttgggaggccgaggcaggcggattgcctgaggtcaggagttcaagaccagcttggccaacatagtgaaaccctgtctctaccaggcgtggtggcgagtgcctgtaatcccagctactcaggaggctgaggctgaggcaggagaattgcttgaacccaggaggtggagttgcagtgagcggagatcgctccactgcactccaggctgggcaacagagcaggactctgtctcaaaaaaaaatacgtaaataaagatcatggtggccacagtgaaggacttgagcctctgcgattcctgagggtaaggactgccttagaagaatgtctaataattctccccatggggtagcttaagactttttcctgattaagttctctgtactcccatcacacccagctcaattatcatttccctgacaaagtcctccctggcttgaccaggtaaaactagtctcatgtctttcatgggtgttttgtgcccctacaacttttggtcaatccatttatcatacgtttatcatcttgttccctccctccctccctttcttttctttttttttttttctttctttcttggatttaaatgctttttgtaataaaatacacacctatccatccatttatccacccaaacccaagtagttacagcatggatttctttgaggcagaagctagctatttcttgtttatcttttgtctgttatcaagttcagtgctggaatgagtgaatgaggaaatacttggttccctttgaatggcaaaaagcgcagtgtccttctgtcacataagaatgacaaacacgccagcccagcagaccaacaagcctgaacaggttatagttatctctactgccttaacacaaggcccaaagagctctgagtttgaaatgtatcctaatgccctgaggcacccattttccaaactgatcatcttccccactctatctgggcaggttcttcagacccagaagaagaaagtgttctctactccaaccgagcagcatgtcacttgaaggatggaaactgcagagactgcatcaaagattgcacttcgtaagtggccaagggtaattttgggatgcctgagggtctcagaagaggaggctgggttaatctggcttgtttcttctttggaaggatcccatcaattacatctgggacagatattaagaaagtgtcactgagtttcaccaggtcactgagaatgggagtctttatttggtccttatggcccgtgacttgcatctttggagtcttggctctgctgccgaaaaaggagtgggatgggcagttagaagcaggccgtaaagtctttgtgcaatttgaaacctgggaataaggtggagtggcagaccagtaactggcttgcccaggtgcttttctgggatgggagtatgtgaggggaagggagcgaaggaaagaaggaggaatagaggttaatagattgtctcagaaggagaaaggaaaaaaatggtattcatgaatgaccagttttagaggacactgaacaatgtttcatatctctttttcttcaagccagtctaatattcttttatcatcattaaactctcacatttacctgaaatgtgttctcagatctgatgtcctctgacattgctttagattcctgccctggtgatagccaggagagcaggaggggtgtgagcatactcacagagcctgtgctgaattaatttgtgccatgccttgtgccagatttccctctttgagtgttcacaaccaatctgtggggtacggttaccatgtgtcccaggccagaacttggttgctgagggttggggcagtaaagtgatttacctgggtcacatagttagcagcagaggtggaattcagacaccaccccatctgactccaaagcttgtttgttattcccactagaccacaactgtaaaaaaacatagtagcatgaaagccatgaggcttttgttcttgattttgggggaactgaaactatgaaaattgatgcatgtgcacacacatttaacaaaattcatgtttctctgccttctttctcctcctcacttcagtctacgttgaaaaatccctgttctgaggtttggcgtttttagccatgtctctcggccagaaattacttcctgtacgctgagtgctccagataaccctgcctggaagaaactgtagggaaaccctggtggctcagcagccagccagttgacatttttgcctcctattctagagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacaggtgagctccattcccagcaggtggtctccacggcaactccctgtccttcttgattggctgcgggccattgccttgtctgtcttctgaggggatccctttggctacacttaaaaaactcccgatgggcatgtaggggaagctgagaaaggaaaatctgcttttttatttagcaggttttcagggagtcaattactaagattgattgattgatatttgcctacatgtgcctcacagtatctatgtacacagtaatatttattgtacactgtttaaggtgttgtgcccggttcagtgggggataccaaaatgagaaagagatacagaccccacttaccttcaaagcgctaacgctaattagaagaataagacacaagcccaagcagctatgacaagcctaaaaggatatggtttgtggacatggttcagtatattgcactgtgaccaatccaagaggttccccaggtgcaattcctttctggtctctgagcagttattggcttttatctcatggatattgtcatttgtataactgatcatgtttcccctctgcgtgtgcggctagaaagccaaacactgcactaatagcaaacccttaacagggacttcatggtatgtatttagtgctttatttctggcttgacttgtctgccagcattctttgttttctctttgcctcctttttaacttatctgattccacaaaatctaccaattatgtgacagactttgctctaggacctgggctgatgactgagacatacctcttcctgccgtcatagaggtcccggtctcaaggaagacaccagtcagtaataggcaagcacaatacaacatgataagcgccatggtaggaggcagcacagggggctctgaggccagaaaggagccacctagctagctgagagggagagggggaggccagagagagcttttcagaggaggtgagctaagaatgagagatatggggtagggggttagccagaagacagagcagcgtgtgcaaaggtgagcaagtgtgacagatcacaggaattgtaagaagtcggtttcacatggtgctgcaggcaggagctcagcttgggacaggttggtgaggccaagtcacacaagacccagggttcagggcttggacttaatcctgagcaagtcagcctttatgaaaaggtctttagcagtggagcaacatgagcagatttgtattttagagaaaagctctttgctgccatgttgagggatgatatgaagggcaacagaatagaaaggagtcatgcagcaatccaggggagagggtggagagaaaacaatgggaccagtcaggggacatgtaggaagtatatcaacaagctttagtggttgcggggtatcgagaagggaggaatagaagaagacactcagattattgacattcagtcggaggtgactgtgggacataagactagagatctaagtaggacggttgggtatttacatggaacaaaggaagaaaatacaggccagacataaggatttgagggtcatcagcgcagaggtggattagggctgtgagaaagaaaaagaacatcacagctagtgtgaagaggatggagctttgagaaactccagcatttgagggacttacagaggaacagcagctagagaggtgggaggaaacagggcattgatgtcccaagggaaggagtatttcaagaaagatggagacatcattagtgtcaggtgttccaaggagcttacattaaaggtttggcaatgaagtcaccggtggctctgatggaagctggtcagtgggatcaggagccagagggcaatgctttcagaaagtcaggcttgaagagaagctggggagtatacctgtgatggcaaggggtgtccagtatggttttattaggtgaggaaagagttaaagggacttaaatgctgacggttggagttagtagagaggaaggatgaagatgtgggagagggaggtgctgcctgggtgtggtccctgaaagaggcaagaggagatgggatccagagcttaggtgggtggattggtcccattgtctcttctgttgtgacaggagagaaataggaaggattgggcacccaggcaggtaggtttgtatttggggtatgaggaagtttgctctaaaaaaggggaagggccagggaacaggtttgaggagagcagaggtttgaaatagcttggccgccaggaaaacagcctagccagagacatcttggaatttgtagtgatacagtctgtggtttttattcttgtaatataggaaacatggttgtaggagcagaaaaagtatacagttagcattattcactcattcaacacataactgattgggccttggtggttgctaggtgacataccaggtgctggagatcagttgacagaatgaacttggtctctgggtggcattttaagctgaaatctaaagaataagttggagttagccgggcctggaaggtggcaatctttttccaaaatgaaaatggttgttctgggtagaggaaaaagcatgtgcaaagtcttgaacagaaggatcagaagagaatgtggctcacagtgaagggggacaggaaggggtggggaccagatctcacatgccacattagcctagggaattgggaacccctgaggagttgtaagatttgagaatgacataagctttgcattttttaaaaagcctgagcattaaacaaatgtcaggtgcttgcatggttgtgtacttgattcattgataaaatatgaaacaaaatgtatgattctttcttggagaaactatagtctttttggatcatggtttaagtatccttaacaagcaacagatcaccactttaaaggtaacatagtttgaccaagctcaaggaatgtcatggggactgatctgagatggtgtttatgggttcctgtattgcacgtgttggaggagctaaagaggtggttccgaccagggggagggtggcagctctggctcttctgaaaaggcctacctcccatgggtgtgtgaaaggagaaatatcttcttgacccagctggaaacctccctgcaatcctgccttcttttccagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagaggtgagctgtgactccctgcccagagtcttgcaatctcccactatccattttctttagagtagtcctgcaaaaattggcattgtttagctgagttataaaaataatcttaggaacaaagtataaaacaaaatacaagtcttcacctcttagagactgttttctcagctgtatagtgagggtgatgataaagtcttcctcacaaccatgaggactgaatgacataagacatgtaaaactcccagcctggcacataggcatgcagtgtgagttcccttctctttcctctggtagcacttgggatgtagtacttaggatgtttttggttgcaaaaacagaaagctcaacatggtaaacatagtatagggaatttattggctcataaaactgaaaaatccgagagaattcaggcaaggtttgctccagcagctcagtatattaacagactaactccatttttctgtacttatcacagctttattttctgttgtgcgtcagctttgtctttggcaagcttccctcctagtagcaaaatagctatagcagttcccggcctcacatccataccccatgcctcatgacccagagaaagaaagtctttctctgatagctcactaggaaaagataggatttttttcccccaaaaaactctagctcacatattttctcaatcattttctcaatctattctggtcttcatggtcacaggccattccctgaagtacacaccataaccggcggatgagattttgtgattaggtcaccctgaggcacctgccccacctccagaactagagggtgatgcttcccaggagcatgtacactgtgtgaatccctggagaagcatgaagaagagaaaggagatccaagcagccaaaaacaggagattcctcacctcaactgtatgaaatgaagaggccatttgtcaggcactaggaagctcttttaatgctccaggggaatggtcccagcccagcaagctagggattcaggctagaggtgcagaagggatcagagatggagccctgccatgtgtaagtgacctataggtgttaggggaggacaagagttactcaccttctacaggagaatgcctctctggtcatgggtagcattcactctggtttgtgggagcctggtaagtgttccccactcttctctaggatgaaaatgtgcggtgctaatgaacctgatggcatcagtgccattgatttcattctttcaatcagtgcacctaccattgatttcattctttaaatcagtgcacctaccattgatttcattctttcagggtcactgagccatgtgttccaagccatgtgtatgctaagcagtgtgacacagaggacagtcttggccctcagggaactctccctcagttgagggactgagacatgtaaacagtgtcttaaaacacaaggaggaggaacatgtgctttagagtcttagtgtttgaggacttcaggatagaaactgacttaagtgcatgagggagtcggggaaagactcagaaggggtggcaatggaggtggagccttgagctggaccttgaagaaggtcatcaggtgggaaggaaggagaatccttggcagagacagtggagagagttggagaatgaaagtgcatggggggaacagtaggaataaggatgactgcagagtggtgtgttgcagggtgccagtgaagctgaagccctacttcaagagaaacctgtgtgcatgtgcacagggagatgtacccacaaatgttcgtagaagactgtaatagcaaaaaacaactggagataacccagatctccataaatgggagaatggacaattcagctttggtattgcagcaatgaaaatgaaggagctgcaggtctgtgcatcaacacagatgaatctcagaaatataacattaaggggaaaaagaaaaaccaagtcataaaagaatacacagacttattcttctgtatgaagttcaaaaacaaagtaaacagcaaatgatctgtgggtactgttgtatatagttatactgtttaaaaaggtggggaagaagcacagaattggggataatagtttcctccagcagtggattgaattgaggaaggtcccccaggacttcaaaggtcctagttatgttctttttcttaaaccaggcaatgaattcagggtgtaaacctataatcttaccctggtcataaatatttagtattttataaagatagttttaaaaatttttgaaaagcagatgatatggagctgaggctggaataattaattggggccaagcagtgaagggcctgaacaccaagttgagcagcttggatttcaccatgttccctctgcttcctctccttgaaggctggagcagagctgcatgtgttagatgagggaggatactcacaggctcagcccaaaccagaaatgaggaatagcaggctcttctccccttttctcatagcccagaagctataccttttctttaccagatatttgtttattagtatttatttacttattgtcctgctttaagtttatagtgtgttccgtactttcttacatactctcagatttgaccctgaaaatagccatctgtggaattagtattgccctattttattggtgaggaaattgaggtccaaaagttaggtaggtcacacaagatcttccagctaccaagaggcagtgccaaggctagaacctgggttgctttttatcatttatatatttttatgtgcatgcaaaaatgtttttatatcaggattccccaacttcttgatgaaaaactgttgaattgcccagaagctattaattgggggaagtcattaatcaggaaggatgatttacagcaggggaggaaatctctgggagagaggattgtagtcagtttggaagggacgatgctgaagagacctcactgatctcagttgggtgctgctccatggtttttttcctcttctgaatttgtatctagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacaggtatctcctatacagctgctggcctggggcatttcaggacatttgttccatagtcttctcttggactgcaatgggcccttcatccctagcatttagtcaagtatgttatggctgaaaacatgcatccacgttgtgagctagccatgaccagtggcattcattctctcaaaagggtagaaactgagggatgccaaatggtagcctgggctttgttggcccctgtccccagaattttcataagcatgcaatgtaactaaaagcagtgtgcctgctctgcaaacacaaccctaacacaagtctcttagcctgtccaccccaccacgctacgctgctccctacccttctccaagaccctcctgttagaaattctggcaccatttctgtctgagagtactggcccagaagccaaaatgtgaagtaaccattgcctggcatgagagcaggaaggatgggtacagtctagcctgaaaggttagacttgtgggcctgtagaaagtcctgcaccaggagctgccgtcagtgaccactgactgagaacctgggagccagggtgcggtcccttcactgtgtaggagtgattgttctccaacaatgctcgtataggtggtctttctgttttagtgtttagaaaattgaggctcagagaaggaagggttttgctttaaactcagccagccagtaaatgttggcacaagaattggaatctgacttcaacaagatcttcctgttacttttactctcagaagcttgaaacattcagcaagagaccatatcaaaaccaaatgcttagtataaaacattataaaatgttagaaatctgtttatccttccctaccagcatacacatatcactctctagttcaaaaatcttggatctaatatagacacattgttccttattccaaactcttgagataaaatgtgttttccagccacggtggctcaatgcctgtaatcccaacactttgggaggctgaggctccgggaggatcacttgaggtcaggagtttgagaccagcctggccaacacggcaaaaccccatctctactaaaaatacaaaaaatcagctgggcgctgtggcacatgcctgtgatctcagctactcaggaggctgaggcaggagaatcacttgaacccaggaggcagaggttacagtgagccaagattgtgccactgcactccagcctgggtgacagagcgagactctgtcacaaaaaaaaaagaagtgttttccattttagtgaggtaatatggtctgaattatgtaacaccccagcagtgtctggggcagcttgcagaagttaattattagtatttctgccagtgaaacttgaaaattccatgttcacatggggtggaatagagaaactaaatagcttcatgtcagttcagatcaggttttgctgcccaatgagttggaaagagaacttgtagttttaaagcttatattttggaattttgcacctgtggttttatgtggttttattgctgattggaccagaggggccacaatttgccaggctaatttgaaaaagaagcctgcagcctatttgttccatatttgtgtggcatcttctaactcctctatctctggaccctctttcacattgcttaccttatgctgctggacacctccattaactcatttttctggatcattaccatatttggagctgtgttttgtcttgtttagatactgttcttcatgcaggtgtctgtgccacactgttttaattgcttttgctttataatatcttatagggctggtcttttcttcattcttcttaatcagagcattcctagtattttcccatgtttgttcttctagctaaagcttcggatcattttggcaaattccaaaaaatgtcttgttggacagcttttggttgtgattgcattggatttataatttaatctagaggactaatgacaaaacaactttcagccattgtggctaacattttatcatgtcctggaacgtcttggacatagtctaatgctccacctcatgtacgcccatctgaatgacacaatgcccaggctttggcttactttggctccctttgtgcaggtgacatctgagtgcatagcacctacaacttgccagccctgaaacagctgtcataagaatctcacttgtactcacaacagttcttcagcttagatcattgtcctgtgttacctaatcaggctcagaaagatgaattagtgaccacaaagttaaacaactagtacatggtggctgagatttaagccagatctttgtgactccaaagcttatttccctttcactcacttgtgttatttcccaacccctttgtaattaaaacccttctgactggatacagttacttcatttaccaaaagtcaagggggtttattttattgcctgaagttatgcattttgttcatcttaaatatagtctttagaagtctcacatgaccctattaatcacatttctattctgaagtcacgatacacggtggttcctctgcttcccagacacttggctatttctttaaattgccaagcccattgggaggaaactttaatttccttagaattcctctatgtttagaggtggctcatgcctgtaatcccagcactttgggaggctgaggtgggcagattgcttgaggttaggagtttgagaccaggctggccaacatggtgaaaccccatctctaccaaaaaatacaaaagttagctgggcatggtggcatgcacctgtaatcccagctactcgggaggctgaagtaggagaatcgcttgaacccaggaggcggaggttgcagtgagctgttatcatgccactgcactccagcctgggtgacagagtgagaccctgtctccaaaaaaaaaaaggaattcttctgtgttcaaagtttaaaacgggctactattctaaaacttggtgatttacaacaaccattttattttgcttgtaatttgtggagtcaggaattagggaagggcagttctcatttggggtctctcatgcagggtcagcaagatggtagctggggctggaatcctctaaagccttcttcctcgaatgtctggcagctgggctgcctgactcaaatggctgggtgatggaactgctagagcaagctggcacctctttccactttcttagcagccttttcatgtgtgctgctgtgagcttcctgagagcgtggtggcctcagagtagttggcttcttccctgtcagttcaaggctccaagagcgagtgtttccagagaccaaggtggaagctgcaaggcctattatgacctaaccttggaagtcacatcgtgtcccttcctctgtcctctgttggtcagagcagtcacagagcctgcccgaattcaaagagagagagcagatacacctccgcctctcagtggaggattgccaaagaatttgtgcctgtcttttaagttgttacaagaagatttttctctccgttaatttatgaattccatgcaatcacaaaggactagtagaattttcttctttaaattcatgataagtcagaaaaaaatgagaacaacgacatgagagaatctggtgtataataaagtctggggcaaagagagattatttaataagaggtgttgggttggccaggttagagttaaacttgaatcctaccttgcttcttattttaaagtaagttctgagtggatcacagtttggaatgtaaaaagcgaaaccattaagttctagaagaacacatggattaactatcttgcagtggggaaggtattcttatgtgaagggaaaaaaatgttacagaagtcgttaaaggaaaagttagagaagtttgatttcaaaagattaaaaacccttattaaagatgttcagctttacccacaactaagcagctaaggcagtgagatagtgttttattccatattggcatacatgaaaatttaagacccaaagttggtacagttgtaggaaaataggctctgtcaataactattcagcttttttggaaagcattttggcagtaacaatcagattttatttctttttttgttttgttttgtttaagagatggggtctccctatgttgcccaggctggtctcaaactcctgggctcaagtgaccttcccaccttggcctcccaaagtgctgggattataagcatgagccactgcacctggccagtcaggttttaaaatgcatgtatctttggatacagcagtcccttgcacaaggatgttcatcatggcatcacttatttacaaactggaaacaatgaaaaatacctcttgataggaaattggtaaaataaattatgctacatccaacttagtgaataccctgcacccactgaaaacagtgaggtggaacagatgaacttatgtaatgagcgcccagacatctgactgttttgtttttagtgactgtctttggagagaaggactagatctgaatgaggaagatatatacacacatgcacttttttgaacccacagatgcagaatatattgtatggatgcacataacttttttccaacattttattatgaaaatgttcaaaatataggaaagttgaaagatttgtacattgaacacccatagacctaccatctaaattctacaattagtattattacattgccttatcactatttagccatctgttggtctgtattattgtgtttgatgcacttaaaagtaaattgcaaacgtctttacatttcaccccatgtcagcattatatcattagagttcagtagttgttgggtttttttttcccccttaaagtagataattttttaatctgtcaagggaaaagtttcaggaaaccttttctttgcttgaaagagctcagtataggagagcgcagtacagcatgatagaactagatgagatcaggatctggagtcccatgaacgaacgcccgcctatttgaatcctgggtctgccccttaatactggcggtacctggcccaagttcctttacccttctgagccagcatgtttcatccatgaaaagggctaggattgttgtgaggatttaagaagacataaagtaaccagcacagagtaggtgttcagcaaattggagatcacttctcaaactactgcgtggcatgtgggtggcccataagacgtgactgaaacctctgaaatggtctttcccttcagagcactctgctatttggtcctgaagcagtacacagaagcagtgaaggactgcacagaagccctcaagctggatggaaagaacgtgaaggcattctacagacgggctcaagcccacaaagcactcaaggtaaaaaaaaatcctggccaaaaggtcccaacatagctacagagatttatgccagtgtcaccatttacagggtgtagccaagctgagacaatatctgcagcttttccttctcatcctgggcccaggataactcagagcaggcctgtgggctggggtttgaaaacactttgctgcctcagcagctatccccaccccagtccgggaaccttcccccacactcctgtcttttcttctattaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaatatctgctgtgctttcatttatgccttttcagctttgcacctggaactctgtagtaataataaaagttattgcttattgggcattcattcatttgttgaacaaatttattgacatgtctgcatgggccaggcactgtgaatagtgctagggagatagatagatagcagtgaatagacacagcccctgctctcagagggctggtagtccagtgggaaggcaagaagttaatcagacaaccacacacatgtaaaattgcagcttgcctgagtgttgtgaagcagtcgtcagtgatttccctgcccaaaaggggaaatttgatgcagtggagggaagggggtccctgagtaagtaaagcttgaattgagttccagatggggaggttaactagtgaagaggggagggaaacaccgtggacagaacggccatgtaaggccctcattgggagcacagccagtgagtacagggacctaaaagggctgatgaaattcacaaaacatggtatggggtgaggctggagagtgctctaggatctagctagaatcaagggctgcctccctttcctgggctggttttcacctaatggaagtagagttttaggattccacagagcagagtagacaaaggggtctgatcatcccttggctcccatcacatagtgctaggcagcactcggcgttaagcacaccacctctgagctctcttaaggatgagtctgttgtctgagccatcacagacatccaggctgaagcagagttagagtcagacaaaccccatcggcacagtcaagggacagtttcaaagtggggcaccgtaccccttttattgcctcataagcaggcaggactgatgtgaggcaggtttcgtgacatccagtcacaactggtttacatcattctgagctctagaaggcaagcaacttgatttgctagtgaagacacagagggtggggccggcacaacccgaagagactactcattttgtacttcaaaaatgtctgaagaacacaacataagcttcctcatccccatcactcatctttgaaatttaacatcattcagtcttttccagagatgctttgaggaataaaacttctgcttctcataggttaatgtttctaggagagggacacacagctatcaatgtgactgtcttaatggtcatgatggaattctaccccgactcccagagaaggtaaaacaccgttacgtgggaatgacagggcagagagcagatcatgcagggtctcctaggctgtgtaaagtagtccttattctaatgatgggaagctactgcaggatttatgcaaggatgagacattagagaggcattttgaaagaagccttaggactgcatggtggaggacagactgcgggagggccagggtaaatgcagttaactggcagaaggcagtgagcgcaggggttgagcttagctcaaattagtggatttattccactaggtagtggtagtggatttggatctggtaggaggtcatgttggtggattttctctggaagaggggaggagagaaagtggtgtggcagcagggctggggaaaccctctgattttggcttttgcaacagaatggtggggccatttatggagacagaacactggaagagagaatcagagaataagaccgggcacggtggctcatgcctgtaaaccccacccgaggcgggtggatcacctgacgtcaggagttcgagatcagcctgaccaatatggtgaaacctcatctctactaaaaatacaaaaattagctgggtgtggtggagtgcacctgtagtcccagctactctggaggctgaggcaaaagaactgcttgaacccaggaggtggaggttgcagtgagcagaggtcacgtcactgcactccagcctgggtgacagagcgagactccgtctcaaaaaaaaaagaaccaaggaatgaaaaagaaagaaacttagttaaatcataagcttgaatttagacatgagtgttaccaagataaccaggagctgatggcaggtaggcggtggaatgtaagagaggtgactcaggtgctcttaagagttgactgggctgaagaaaaaaacagggagtcatcctcgactgggtacaaatggaagatgcgcttgtaaattagatagctcaggagaacatggcatgagaaaccgagagggcccaggactgagagtaaagaaatgccagcagtcaggatttggggagaagacgatggagctgcacagggaacagattaaaagcagccaaagaagtgggcaggacatggtgaagacaggttggaggtctgtggagcggagaacaggaagagtgagttgctgagagtggcagagcagccttgaggactcggtcagatttgttgctggtgaatttttagcagaacccagtctgcttgggtcatagtagccactttcactgggccgctccggtacacgagagggcaaagacctggactgtacgtccctgatgggaggtgagcactaactgacacaaagaagcttttcgagagacttctccattaggggaggaaaatcctgacctgggaaggtaccctaaaacgttcctacaagggttaattatgttacacaaccccttagccagccgagaagcagctgggtgtttgccctgcagggtgcccaagccaggggctgcatgcacatcagatgggggcccctgtagctctggtccattgtgtgatatccatgtcatcatccactgtactgttgatgggtcagttcctaacacttctcctgctcttgtgtatatgccctctgtgtacttcagcactcctttagggtttctgtttcttagagcctgagccccaccccagtcatgtctaccgtttgctctgtccccacctccctcagacacaaaagggcctcctgggaggcaaggcagattttgcagcacttttaatacacaaagcaaaaggtaataggctggatgggtgaccaaccttcattcacatacagagcccaagtatagatacagactaattgggaaataagttagagtttgcagggccttagggctgagagccagaaacactgtccttttggcagccatggaagcgaggatttccttttctgaggacaaaaaggtaaaaataagtgtttttaaagtatggcagacacccagtcttcaataaagaaggtggttacatcctggccaggccttcaggcaggcagaatggagccaggcagggccctgggaaagcccaaactattctgcatgaagccaggcagggcagctggcaagagggcacctccttcaccctccaccaccccccattccgatcacagttaatcatctcctctgattctcacaacttcctccaaactctttggtgcttcagagaaagccaggaacacggcgcaattctcagtgtttgtgaaagtcagtccctgcctatttccttacagcttctcccgggctcagctgcttctgtcaccattccacccacctggtttcagtgcatgtacgccttcggctgctccatagcctggtgtgcctgcagcacggccactgcctcgtctatctgtgagacatgagtggcgggggggcttagtgcagctatcttagcaggtcacagaagagccttgatctccccctcgctcaccatcctggatacaggatcctcctccatccacagggtttctgtggaaccctcccatccaccactgcttgcaagatcccatggccctgtctgtcacctttgacacagaggtacattgctggacagctggaaaaatcttaacccttacactgagtcacaacacacttccttgtaccaaaagacctacctacagaacaacacagaattagtctacggaagggctgaagtagcaaacccttacctaaggccccttccactcttaagattcagcaggccttcaggtattagcaagaagaaacactttatctggccaaacagctatccactggctccactaggagagcccttgtcgttagctctcctcctgccccctcgggctccctgctgcccaggctcctgcttaccttggcatggagggattctggagactccagcatgagcaacagctctgagttgtcaatctccagcagcatgcccgtgatcttgccagccagctgggtgtggacatcatggataagggggtagagacgctcccctgtgtggaacaccttctaatggcttgtgcacggcctagctcacaccccagcatcccagggctcgtatggagtggagcactgaggacatctgggttcttctcccagaactgctccttctaggctatgacatttaacacttgatcttctaacatcaggtacttttaatgactgggcctggtattggtggtcagcccatctcagcaatgtgtccagggcccagccaggactgggtgccttaagtgggggcggaaaggatcgtcccatgaagaaagtgaaaatgtttacagagaactactaacaaagacttctacttccattaagctcattcaaaatgtttctgggtgaggccaggcatggtggctcacacctgtaatcacagtactttgggaggctgaggtgggtggatcacctgagatcaggagtttgaaaccagcctggccaacatggtgaaaccccatctctaataaaaatacaaaacttagctggtcatggtggcatgtgcctgtaagcccagctactcagaaggctgaggcaggagaatcacttgaacccgggaggtggaggttgcagtgagccaaaatcgtgccactgcactccagccggggcagcagagcaagactccatctcagggaaaaaaaaaaaaatttcggggtgaggggaaggggtaatgtggcaaaaccctaagtaagctgaggaaacaatggggcagtggtaatgggggccttcagtaaagggtctggaggtctcgggggccatgcagtaaagaacctgccaaccaggaacaagcttgtgttcacttagtggcatttttatcagggcctgccatggacactaggggtgaagatgaattgcacaaggaatccagaatctatgggaaacatcatgtatttaccaaacgcacagatgccccacctgcccgcattgagcactggaaactggtgaacagcagcttcctcccgttcaggagaggtgtgaggaactttaaccccccacctacaagccatttctcagcagaaacccaagaccatacccctactcctccctttgtcccctgatctccccacatctggactgtctcccaacctcaaagtcacaggacagcagcagtggaagaaagctcaggaccatccagtctgaccagcgttttaagacaagataacaggtgcctagagaatagagccagcttggccacggtcacccagtaggggggtcggtgacaaagctggaatttgacctcacgttggaccaccaggtgaggtgtttcccagcaggctagccagctcgcagccctcctcttcttgctccacagtaggagaaccagccactcaccaatcatctgcttttgctcatgcaggggcgccgcagccagcatggacgcggtcaggggctcctgtcctgggatgtgcacagccggctcctggacctgcatggtgccggggacacatcccttaatcaccatggacaggcatgtcctcaaaatacttaccctggcaagtgagcagaaggccagggaggcactggaggaggggaacagagggcaaggtctggatgatcaggtggggtggagagtccccaacaagggcaaagtggattagaagacaaagtcatgcctctagcttagacgtttcctgtagtgctacgaacttataaaggtccctgatgaacgttgataaaggaaagccctgtgttaccaataactttgtgccaaataaagcactttttatcaagtagatttatggacatgtccccggcacacctctcaccctttcacatcttggtaattttaaaacattttggccaggtgtggtggctcacacctataatcctagaactttggaaggccaaagtgggaggatcgcttgaggccaggagtttgagatcagccttggcaacataatgagacccctgtcactacaaaaaaatacacaaaattaaccaggcatggtgtcacatgcctgtacttggaggctgaggtgggaggatcacttgagcctaggagttcaaggctgcagtgagctatgatcacaccactgcactctaacctgggtgctgtcaaaaaaaagaccctgtccaaaaaaaaaaatagacatttttgctgtttaaagactgttctcattcattttgcaggaaatagttcaaaagagacacattgaaattctacacaggatatgataatgctgaattttaggccttttttaggggagggagataaatacacagtctttgattacagtaagtattttctgttttgaagattaagtacatcccttcaataatcagcatattcttagaatacctttccttggtgttcatcacaaatactaaggatatccaaattaattttggtaataaccgaagcaaaacaaattgtaaataaaacgtaatgctggccctctttccccttctcgcagtaagggtgatctcttattgattgtacacattaataaacgaaactttacaagccaagaaaagaaaaaaagccaaggcccaacaccttagctaaggttctgagccaggcggccaggagcccaggctaagagcaggcagctgggctggccttacccgataggtgctatgtgctgctgaggaacatttgcacggcaggagcggccggcctggtgtacagcatcctaccccactgggtcctgtggtctgagtaccaatgttggctgcaaaacaaaacaaaacaaaacaaaaaaagcagagttcaaatagctgctatccaaaaacaaaacaaaacaaaacaacaccaaaacagaaaataacaagcgttgacaagaatgtaaagaaattagaagactgtgcactgttggtaggaatgtaaaatgatgtagccactacagaaaaacagtatagggctttctcaaacagttaaacagaattaccatatcatccatcaattttacctctgggtatatacccaaaagaattgaaagcagggtttcaaagagctatttgtacaaacattttctttcttttttttttttttcctgagacagagtcttgctctgtcacccaggctatagtgcagtggtgttatctcggctcactgcaacctccccctcctgggttcaatcaattctcttgtctcagcctaccaagtagctgggattacaagcacatgccaccacgtccggctaatttttgtatttttagtagagacagggtttcaccatgttggtcaggctggtttcgaactcctgacctcatgatccacctgcctcagcctcccaaagtgctgggattacaggcgtaagccatcacgcccagcctgcacaaccattttcacagcagcattattcacaatacccaaagggtagaaaagtgtccattgatagatgaatgaataagtaaaaatgaggtctatacatacaatggaatattatttagccttaataaggagattctgacacacgccacaacatagatacatcctgagacatgtaaagtaaaaaaactagccacaaaaagacaaatactctatgattctacttacatgaggtaccaagcaagaacagtcaaattcacagagacaaagtagaatggcagttgccaagggctagcgggaggaggaacgagaagttatggtttgatgggtacagaatttcggctctacaagctgaacagagttctggagagtggatggtggtgacagtgcacaacagtgtgaatatacttaatgccattgatctgtacactgaaaaatagttaagtggtaaattttgttatgtgtattttaccacaataaaaaggaataagcaggggtgtcagggcctggcagcaacctaaggccagagactgagtatacctcgttcacgcagaacctccagtgctgagcttggggccccagcacactgtggatgtgagaacatttgcagaatgaaagaacagatgtgcttgctgtacagccaaaacctacacccttgtttatagtcactgcaatacttaccaggctttaggcccagtgctaagccctttcatgcatgatctcattgatcctcaacaacaagccgggcatggtggctcatgcctgtaatcccagcactttgggaggccgaggctggtggatcacctaaggtcaggagttcgagaccagcctggccaacatggtgaaaccctgtccctactaaaaatacaaaaattagccaagtatggtggcgcatgcctgtaatcccagctactcaggaggctgaggcaggagaatcgcttagaaccccggaggcagaggttgcagtgagccgagatcacaccattactctccagcctgggcgacagagcaagactcgatctcaaaaaaaaaaaaaaaaaaaattaaggctgggcacagtggctcatgcctgtaatctcagcactttgggaggctgaggtgggcggatcacctgagatcaggagttcaagaccaacctgaccaacatggagaaaccccgtctctactaaaaacacaaaattacccaggcatggtggcgcatgcctacaatcccagctacttgggaagctgaggcaggacaatcgcttgaacctgggaggcggaggttgcagtgagcagagatcatgccattgcactccagcctgggcaacaagaatgaaattctgcctcaaaaagaaaaaaaaaaacatttaaattctctacaataaaatgggggtactatttttgtccccattttaaagattaggtgacagatatagtagtcagcaagggcctcatagtcagttggtcccaggaactggaggccaagctaactaccacgctacagtctccaaagtcagctttgctcaccgagagggcatatggcaaggtcaccatggaggctggtcctgactcctagtgccaactttgccccacccccattccccttggccctacccacactcacctactctctgggtatgaggcaccgtgcgtggcacctgggtggaggcctgcctgacactgctgatgtgggccggggggcgccgaggcacaactggtggccggaccattgaggcacctggagggtaggcagcttgtggtgcagacaccacagagagagaaaagttggatggagtggtgggaataatcagggtggcacactgtgcctagaagcttccagggccaccaagagaatgggaagggaaactacaacattcacaacagaaataggagtcaattcacttagacccagaactccagaaagggggagtgtaggaatctacaatttcaaagccagctcgtgtctacctagagccccaaactgcataagcaccaggattgtacaccttagtccctcaagatagtttcaagtgagcgtgcaattcactcttacagaggagggcctttggtcaacaatatagccagaggaatttcaccttctcagctttgcaagaattttcagagtcacaaatcagaggcatctttggtgatgactgctggtggctagctgcgtgtcttccattggctcaccactgtgcttggtactttacacacgtctcattcaggcccatgctcagaagaggaaactgaggctcagagaagtgaagtcacccaccttgggaagtggcagagccaggtttcatccctgtgttatgactgcctcacggggcccacaccaataggccagtctgagagtggaaggggctgggtcactcacaggaaggtctaggtggctgggatgtccacctgggggcaggctgggtgggtgtcactgggccacagccatagtatgcagcctgggctggaggctgcatgggaaaagaagacccagactgaggggcttggcggcagggtaggtgagaagctacacctcctcagggacaccatggcaggaactccactggctcctgcagggactggtgagtcaagacccacaaggctgtaatgaaagctccttcctcccatctcaggatgtccattagccctgaatcctgcagggcaaagatcttagatttcaatcttggctccctgtcagctaacccaatgacctggataaaaagggtgacatcttactccaacttgtgcagcttaagcaactgctaaaaggagaggaatgttcttaccgtggtggcctttaatgggtgacatctttctacttcctgtaagtcccacgaggtcctttcccaaaccatgctcctcagaacattaacatccaggggagatgttaacaggcatcccacaaaaaaatgaccatctaagctggggaaatgctggataatctgtgcctgttttggagagtctcagtagacattggcatcttagggtagaatagtgtagatagtaaagaaatttagggccgatcatggtggctcatgcctgtaatcccagcactttaggaggtcaaggagggcacatcacttgaggtcaggagttcaagaccagcctggccaacatggtgaaaccccgtctctactaaaaatacaaaaaattagctgagtgtggtggcacgcacctgtaatcccagctacccgggaggctgaggcacaagaatcacttgaacccaggaggaagagtttgcagcgagccaagatggtgtcactgcactccattctgggcaacagagcaagactctgtctccaaaaaaataaaaatttaatttttaaaaaaatgtagggcgggggacggtggcttactcctgtaatgccagcactttgggaggccaaggcaggagaattgcttgagcccaggagtttgagaccagcctgggcaacatggcgagaccccttctttaaaataaacaaaaaaattagctgggcatggtggcacacacctgtagtcccacctactcaggaggctacagtgggaggatcactcaagcccaggaattcaaggctgcagtgagccatgatcatgccattgctctccagcctgggtgacatggagaccccgtgaaggaagggaggaagggaggaagggagggaagaaggaaggagccatgatcacgccattgctcaccagcctgggtgacatggagaccccacgaaggaaggaaggaaggaagggagggagggagggagggagggagggaagggaagggaagggaagggagggaagggagggaagggagggaagggaaggaagggaggaaggaaaaatgtaggtcttgcttaacgcagcatttcccaaacttgctggatcattaagagtctttttcagcacaacattcacgagcttctctcactgggaaatgccatttgactaacactatctctcccttttatagagagggaaacaaagacttcctaatgagtcctcggcagaagcaagttagaaacctccatttccctagaactctagtcttcatgctctgccttgctggggcaggggggaaggctgcggtgggagttgcgggcaggccgtcacctggggcatggcaggcaggaagtagctggagggctgctgaaaggagcccaggagggggttgctcagggtccgcatggtggagaggcgctgcatgtactggttggtcaagatggccttccgctcctctttgcgctgggccagtgccacgtagagtggcttggtgcccacgatgcgcccgttcatctctgtcacggcctttgtcgcctcttctggggaggaaaaacacacaaagccaaaccccttgctgtggccaccctctgtcatcacctaaaagcaagacaagacaagagctgctggggtggggaaggaaggctcctggggctgcgctgcctccctcctccccatgggctaagcccagcactgggcaggcccgcgagaaagctgtgatggagggatgtagcgtgcacccctgtttactaagctgtgttcgagggatgtagtgtgcacccccgtttagcaagctgtgatggagggatgtagcgtgcacccccatttactgaggagtgatggagggatgtagcgtgcaccctgtttactgagctgtttgagggatgcagcacgcacccccatctatgaggcctgctgcatgccagatactttacatgtcttcacacctcacatgtacaacctcccgatgcgggaggcatcgcggctcccactttacagccgggataagagagactcgaaagagtgacttgtctggggtcactcagcctgtggttcatacgttagccaggactcaacccaacacattgttctggtaagcttctatcgcctctgctaagtaccaagccaagttctttaggaatttggggaagaggttcttagcctttttgttaaaataacctttttactttggagtaactttagatttacagaaaaagttacaaaaacagtacagagggttgctatatatctttttttttttttttgagacatagtttcactctgtcactcaggctagagtggagtggcacgatctcggctaactgcaacctcagcctcccgggttcaagcaattctcctgccttagcctcctgggtagatgggactacaggcgtgtgccaccacacctggctaatttttgtattttcagtagagagagggtttcaccatgttggccaggctggtctcaaactcctgacctcaagtgatctgcctgcctcagcctcccaaagtgctgggattacaggcgtgagccaccatgcctggcctgctgtatatctttcacccagtttcccccaatgtgaacatggtacatttttcaaaactacaaaattaacactggtgcaatgctattaactattttataccattagctcctattaactacaatgctattaactgaactccagacttcactggaatttcactcttttttcccctaatattctttttctcttccaggatccaacccacatggcatttagggtttgtctttttgtttatttgtttgttttttaaagagatggggtctcactctgtcatccaggctggagtgcagtggtatgatcatagctcactgcagcctcaaactcccgggctccagggatcctcctgcctcagcctctcaagtagttagggctataggtacatgccaccacacccagctaatttttttttttaagtttgtagagatcagcaatcactatgttgcccaggctggtctcaagagatcctcctacctaggtctcccaaggtgcagggattacaggcaggagccaccacacctggccctgggtttttaacctttttttagggtgaagacaccggcctggctcatacagcccataaggactagagttatttttaaaatcttctttttttcctttttttttttctttttttttttttttttttttgagtcaggatctcactctgtcactcaggctggagtgcagtggtgcaatctcagctcaactgcaccctcaacctctcagcctcaagtgatcctctcaactcagtctcccaagtagctgggactgcagacaagcaccaccatgcctaattttgttcattttttgtaaagatgaggtctcatcctgttgccccggctgggcttgaactcctggtgagcccacgctcttaatcagtaattttgaaactgtactctgctacccttcagtagaggggtcttaacctgagagtccatggatccccctcaggtaggtcatggatacaatttagggggaaattgcatggattggggaaaaagtgacatctttattttcatattagcatttccttctattatgaatatgggcaacaacaaaaaaatcctggcagtattagccatgaatttgtcatgaagaaaaagaaaatattttcatatcacattaattattgctaatctcagccgagcgcaatggcttatgcctgtaatcccagcactttgggaggccaaggtgggcagatcacctgaggtcaggagttcgagaccagcctggccaacatggtgaaaccccatctctactaaaaatatacaaaaattagctggttatggtggcgggtgcctgtaatctcagcttcccaggaggttgaggcagaacccaggttcttgaacctgggaggcagaggttgtagtgagccaagatcatgccactgcgctccagtctgggcgacagagtgggacttcgtctcaaaaaaataaaaataaaaataataaaagaagcacatactgctttcactttagtattttgaccattatattttttcagtatgatttttttgtacacctaagaatcttattttatgcatttaaaaatattcttagggccaggtttggtggctcatgcctatttttgggaagcagaggcggaagaattgcttgagcccaggggtttgagaccagcctgggtaatataaaaaataattatccaggcatagtggtgctcctatagtctcagctacttgggaggctgagacaggagatcacttgaggccaggagttggaggctgcagtgagctgtgatggcaccactgcattccagcctgggtgatagagcgagactctgtctcaaaaaagtttttaaaaaatattcttagaagggttccacaggcttcatcagatagccaaagggccgggcacagtggctcacgcctgtaatcctagcactttgggaggctgaggcaggtggatcacctgaggtcagaagttcgagaccagcctggccaaaatagtgacaccccatctctactaaaaatacaaaaaattagctgggcatggtgagaggcgcctgtaatcccagctactcaggaggctgaagcaggagaatcacttgaacccaggaggcaaaggttacagtgagctaagattgcaccattgcactctagcctgggcaacaagagcaaaactccatctcaaaaaaaaaaaaatatatatatattgttaagaacttctggcagtcggtagttaataatgataaaatttagcaaagctaacacttatgcagagcttaccatgaacttgatagtggtataagtatttatatccattaattcctttaattttcataattatttttatataaaacaaaatacaggccagatgcagtggctcatgcctataatcccagcactttgggaggctgaggtaggaggactgcttgagcccaggagttcaagacaagcctggacaacacagcaagactcccaatttctaccaaaaaaaaatttttttttaaatcagctgggcatggtggcacatgcctgtggtcccagctacttaggaggctcaggtgggaggatcacttgagcccaggaggttgaggttgtggcgtgccatgatcacatcatggccctccagcctgggcaacagaataagaacctgcatctaataaaaaataataataaaccaaaatatataaaatcgcataacataggccaggcacagtggttcacgcctataatctcagcactttgggaggccaaggcgggcagatcacctgaggtcaagagttcaggaccatcctggctaacatggtgaaacctcatctttactaaaaatacaaacattagtagggcttggtggcgggcgcctgtaatcccagctactcagaaggctgaggcaggagaattgcttgaacctgggaggcagaagttgtagtgagccaagatcgcgccattgcactccagcctgggcgacaagaaggaaactctatctcaaaataaataaataattgtataatatatatatatatgtaggctgggcgtggtggctcattcttgtaattgcagcactttgggaggctgaggcgggcggattactaggtcaggagtttgagaccagcccggccaacacagtgaaaccccgtctctactaaaaatacaaaaattagctgggcatggtggcaggtgcctgtaatcccagctactcaggaggctgagggagaagaatcacttgaacccgggaggcggaggttgtagtgagccgagatggcgccactgcactctagcctgggcaacagagctagactccatcacacacacaaaaaatagatatatttataatccccattttataccgtttgtcctgttaaaaagatggtcaccccaggtgtgccttaactctaagcaatccaaatttacacatttcctttgttcggggagtcctcaagaaggtccatctcctgaagctgtatgcaaggtgtatgatgaatcattacgacaatcactatttcactacttattgaatgcagatgctgtacatgcagcctctttagtagttcttaggacacctggagaggtgagaaatgttgctcccactttataggtgagtaaacaaggtccgaaaagcaaagccacttgcctcagtttctacagctaggtaatggtaggactggggtttacatttaaacctgattaactttaaaattccagctttcaaccatgtttctacatcaaatgtatatgcatttgcttggaaagaggacctatagctttttatgatgtgtaatcaaatttactgatgcctaatttacatgtgccacagccttctctcgcatttttcaaaaggatcttaacctaaaagacaaccttttttcctccaaacacaaggctccctgaaggatgtttacaactggactcagtagccaaaagagaacttctagaccacttcctcagaacccaacatcacatcattcaggcgggtccccccatcctgtcactcacactgatctctttggaaaattcctcattcccactccagctccctacctcctcacagccaagtcaaacactgctgctactgccacttcttccaggcagccttcccttctgttccactgaactcctgtagctttgcctcccatactgtcccccatcttataatccatttgagttagtgacgggctgacttcctcactagactataagctacttgaaagcaaggatcacatctgatttgctcctgtttcccacagagcctggtaaaacagcaggtatttaagtatagaatgaagaaacactggatcatcatcttaaaaaccatctgggcgcttttttttttttttttttttgagacagagtctcgctgttgcccaggctggagtgcagtggcacgatcttggctcactgcaagctccgcctcctgggttcatgccattctcctgcctcagcctccggaatacctgggactataggcacgtgccatcatgcccggctaattttttgtatttttagtagagatggggtttcaccgtgttagcgaggatggtctcgatctcctgacctcatgatctgcctgcctcagcctcccaaagtgctgggattacaggcgtgagccatattgcccagcctctgggagctttaaaaaaaaaaaataaaaagcccaggccctaccccggggatccacattctatgcctgactgaggtgtgtgtatttaagaattgcccagggggttgtaatgagaagccagggtcggaaagccatccagtgagcccagtgtccttatctataagacaacatctgctaaagctcatagagctgctgatgggccagttgccacatctcaggggcctaacagggttgggcacacaattggtgctccagaaatagggaagaacaaatgaagaatgacgaagtccagccctctcactttccagatgggaaaacggaggcccaggagggtaatgtcactggcagaggccagacaacaaaagtcaatggaaatactaagatatgaatttctggaatctggcatacagtaggcactcaataaatgccaaggtgacagtgagccccaagtccagctgtgtgactgggactatatttctaccctcttcccctccagcccagacaaggctgcagatggctacaagctccaacggggtcagcagagccccagaaggggtagccggcaccaaccccctgaaggctgctgggcgagagggtggaggggtggggttgtggggggatggtggtgagaggatggaggggaacgctgtcccccggaggtgcccccagtcctcaccttcgcactggtaattactccatagggagagaactctttcctcagtttgtcgtcatcaatggagtcgtccagattcttcacatacaagttcacaccctgggatggaagggaaactgctggatgtccccttctcctccaagccccaactgccttggggagatcagggaactgacgcaggtacaaggggcatggggagccccaccagcccagcctcctgctccccgtctccctcagcacccaggtacccccatccctcagcgtgcccatcacatgcaagctgtagcccccacatcccaaattcccctgcagttctcaca

SEQ ID NO: 872 - DNA, 690 bp, Homo sapiens
gccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatctgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaaaaaaaaaaaaaaaaaaaa

SEQ ID NO: 873 - DNA, 615 bp, Homo sapiens
  misc_feature 612: n = A,T,C or G
aagatcaaattatattttattctattaaaaaatgtttttgaaaaaagatacttaaattttaaagataacttaattcctaatgatttaaaataatccaagcagagatgaaagagcaaatgcaaatgcataaaaagaccccagagcattgttagcaaaaagcaaatatagttagccaagcatatatatatcataaaagcaataagaaggcataaagcaagtttggggagagcttatttaaaacttgtaaaaatcatttgaatttttaaaagttttcaaacaaattttgttttattaaaaaaaaaatttttttttgagacggggtcttgttctgtcacccaagcttgagtgcagcggtgtgaacatggctcactgcagccttgacctcttgggttcaagcaatcctcccacctcaacctcccaaagtgctgggattatagacatgagccaccatacgtggctactttctaattttttaatgtggtagtgtggaatttagctttgaaagagaattaaagttaatagaatattaacagtgggcttatagttgatagataacaatctgaatcataagccctctatattcatagctggattttgtacgtgtctggtatntat

SEQ ID NO: 874 - DNA, 2059 bp, Homo sapiens
agtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatct

SEQ ID NO: 875 - DNA, 502 bp, Homo sapiens
gctaggttgaactggtacagttctgtgtgtactggtgaatcggactcatttctgcactactgaaggagagaaatggacgcggctttcgaactgctgtattccttccagacccgatagatgaggttccaggtgctgaaaatgaacaattacatacaggaatagaggcctactctgcacttaaaaatatcttcaaaaaagttgctggtcaaggagtatgcagcaatgggtccttcctgttgtgaacattgagtcctagtgggtgaggtgtgggttgttactattaaaaatccttgttgtattgggcacaagatagactgaaattgactgtagtcctcacggtgagtctaattgcagcaacatgtgaaaaaggcaggcaagagctgagtcaggaaaatagacaagcagggtaccttcagaaaggccagccataccaatagccagaatatgatctggaagaaccagcagatcaataaggaagttctgtaaattagtttttactctg

SEQ ID NO: 876 - DNA, 1664 bp, Homo sapiens
gtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaattggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagttttttttcaggaaaaaaaaaaaaaaaaaaaaaaaaaaaaaa

SEQ ID NO: 877 - DNA, 1105 bp, Homo sapiens
gcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgt

SEQ ID NO: 878 - DNA, 507 bp, Homo sapiens
tgtggtccaaaggacagtttatttaaaacaaacgtgatgaggtataggaagaagaaaagaaggagaacaacaattctaacataaaaacacaggaagcatctcaaacttaaaaaagaaaaaaggagtgggggcaatggaggaagctatgtctcatacaaactgctgacctcaattgattacttacatccaaaccttacaaaatagcatttcaagtcagcacttaagccagtgttattagattttcttacaaaaagttaaagctacaaacttcacatttttaaactgtacatagcaacaacatttaagcttttttttttccaagttggtccgagtgcaagctggtaaaagagattttttttccaaacacaaacaagaacatgtattccaaagacaatgaatataatactgataaaaacacaaacatagtgcttaagaaaagatggggtgaggtggagatgtagattgggcaggaacaattttctagtaaataaggagctgcaatcttta

SEQ ID NO: 879 - DNA, 3178 bp, Homo sapiens
gttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaaaaaaaaaaaaaaaaaaaaaaaaaaaaaaaaaaaaaaa

SEQ ID NO: 880 - DNA, 811 bp, Homo sapiens
gcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 881 - DNA, 554 bp, Homo sapiens
  misc_feature 475, 526, 532, 535, 544, 553: n = A,T,C or G
caattattaaatgtttggcactttattaattaaataagctccaaaattaattacatacaaatcaaaggaataagaaacaataaatagtttattcagcaaacacctctctgcagcagccggcagctctgaggccgaggctggcgtcctgtggcagagggcctgtggattgccatgctcgctcccaggggtggctcaacagggacacaggtctactccttccacatcgggtttccggaacaacaactgaactctcattcattaccatcccattcattaccatttttttttacatacacgaaacacaccgcaatgtatagactaataagccaagagctttattgatgcagcaggcactttacaatgagcccaagagtgtccaccttctctgggaagacaggatgtctgtacaaactcttgggtttttttccacttcaaaaacacaagctttcccgtttaccacagcccttggatctgnacctggccaaaccattccttccccaaggcacacagggacctttggaccaanaccagnccngcaacttgnaaaaccggna

SEQ ID NO: 882 - DNA, 784 bp, Homo sapiens
gctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgctttttctgtggaacctcagaggccagcctcgacttcctggagacccccaggtggggcttccttcatactttgtgggggactttggaggcgggcaggggacagggctatttgataaggtccccttggtgtgccttcttgcatctccacacatttccctggggatgggacttgcaggcctaaatgagaggcattcttgactggttggctgccctggaagggcaacgaaaaatagatttattttttttcacagggaaaaacaaacaacaaaaactaaacaagacaaaatcgacaataacaacgacaacaaacacacacacacacaaaaaactatacacaccaacagaactacaaccaacaacccacccaacgcgcggagagaaaacgaacggagacaagggggacgccgcccgaacgccccggaatggatccgcaacaacaccccagcgagggggcaagcccgacgaagacagacgaacgcgacacgtcacgccagagaacagcgcgaacaggagaagagcgagcaccaccaaaaagcgcggcggggaaagacctcgtgaacaccgaggggtgcgagccgacgggcaccagaggccagacaaaacccg

SEQ ID NO: 883 - DNA, 2325 bp, Homo sapiens
acaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaaactgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgctgcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttg

SEQ ID NO: 884 - DNA, 7219 bp, Homo sapiens
ggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgttaaaaaaaaa

SEQ ID NO: 885 - DNA, 5182 bp, Homo sapiens
ttcaggaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 886 - DNA, 621 bp, Homo sapiens
  misc_feature 587, 594: n = A,T,C or G
tttggtagtatgttcagagtcaaacacagcagcactttattaacaaggacagagtaatataatcacaaggaaatacttgttaagtctaaattaaatgatatcttgggcagcataaaatgaatactaacaagggcaggcatctcaatatgtctgtctcacagctgttcaatgtgaaagtagtttgtaagcaaggaaagacaagagcaacatttacaccacaaattgactgtaaaaatacttcattacattgagaaaggtaatcaatggtcaaaatccataaccagaaggagacaccatttgagtatctatcaatgggccaaacagacctgttagattttaatactgcctggtatgcaactcagatactgatttcttctctatggaggaagccaatgttcatgttcttgataacagtcattaatctttctgattgagacagtccaaacccatgtgacctcagaacactaggtctaagagtgaacttcttacattgatatattttccttgagttctttcatggtgctgtatcagcatgctaccataatctgaaaatgacatggggcacaaaggagccatatatatatatntcatgtntatatatatatatatatataaacatga

SEQ ID NO: 887 - DNA, 513 bp, Homo sapiens
gttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattt

SEQ ID NO: 888 - DNA, 1548 bp, Homo sapiens
aatgaaatgtgtacagcttgccgtgttctgactgtacccttccctcttccatgtctgagaatctccgtgtattttaagaatgtgtgaggagagggtggcgattcatgtttcaatgagcctcttttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggatttttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgaaaaaaaaaaaaaaaaaaaa

SEQ ID NO: 889 - DNA, 2480 bp, Homo sapiens
ggcacgaggggaagccctggggcgctgccgccgctttccttaaccacaaatcaggccggacaggagagggaggggtgggggacagtgggtgggcatttagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgcaaaaaaaaaaaaaaaaaaaactcgaggccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgaaaaaaaaaaaaaaaaaaaaaaaaaa

SEQ ID NO: 890 - DNA, 526 bp, Homo sapiens
tggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaaaaaaaaaaaaaaaaaaaaaaaaaa

SEQ ID NO: 891 - DNA, 527 bp, Homo sapiens
gccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaagtgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggaggtggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaaa

SEQ ID NO: 892 - DNA, 528 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaaa

SEQ ID NO: 893 - DNA, 538 bp, Homo sapiens
acgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaagtcttgcgca

SEQ ID NO: 894 - DNA, 552 bp, Homo sapiens
ctcatatttcacacagatgagttggcgaggaagatcgacctattattggtctaggccaataataggtcgatcttcctcgccaactcatatttcacacagatgaatctcagtagaggaaaatcgacctattattggcctagaccaaggcgctatgtacagcctcctgaagtgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaagaaaa

SEQ ID NO: 895 - DNA, 2403 bp, Homo sapiens
tttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcaggcccagccctccactgcagaagcatctggaagcaccaccttgtctccacagagcagcttgggcacagcagactggcctggccctgagactggggagtggctccaatagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggatagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgaaaaaaaaaaaaaaaaa

SEQ ID NO: 896 - DNA, 2691 bp, Homo sapiens
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 897 - DNA, 917 bp, Homo sapiens
acttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcaccccctaccagttcccaagtccatgtgtaccccgctcaccacgggaacggccccccccaaccacaggcatcaggcaaccatttgaaataaaactccttcagcctgtgaaaaaaaaaa

SEQ ID NO: 898 - DNA, 959 bp, Homo sapiens
  misc_feature 809, 842: n = A,T,C or G
tttggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttccgcgttctctgcaggctcccgactcccggggaatcttgggtctgacctctgcctcggcccgggcgcaggccgggctgatggaggcgccctgggcctcgacttaggcaggggcgacgatggctccctcggggctgagcttggcgggacccagggctcgggcacacgtgcttggagtgctgcctccccagggaccgcgtcgcggcacagcttggaagccgagcccagccagcgcaccagcgaggcgagcaccaagcacttgttgagcgacaggtctccccagggcagctcctcgctcaaggccccgggcggcggccgcggctgcaggggcccggcggcttgcgcttcttgcgcgcggggacgcttccnaggcgtggggcaccctgccggaatcgccaaccnccgtgtcgttgaagcctggttccctggtcttggcacgccgccagtggccctccagggctggaagttgccaggcgccatccatttcttccaaggtttgttggatggaattgttgggca

SEQ ID NO: 899 - DNA, 501 bp, Homo sapiens
ttaactttaaaaataacattttatttttgatcattcaaaatgtttcaatcaatattctgagcctaaacgtgtaggtgagtgctttctccatctttgcacatgtgaagtgcgcctgaaccatagccccacattttctcaaacaccatcacactcatagaacagaaaggaaagggcagtttcaccagctagcccccataaacccactccctagggtcctccccagcacctgctaaatttgggaggcctgattccagggggctggataatgagctggcaaaataaacccagaagaatcgtaattgcagacaaagataaactcaggttccagcacagatagacagcccataccagtgcttttgatattagctgcagttaagcgggcaggaaaggctcccactctatggccggtggtgtggtcagctcagcgccgccacctcggcaggttccatcccaccatcaccctcccaatcaggctgatagtgtctccttatgccaagtgga

SEQ ID NO: 900 - DNA, 2166 bp, Homo sapiens
gtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcaggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagtttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctcgagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcaaaaaaaaaaaaaaaaaa

SEQ ID NO: 901 - DNA, 614 bp, Homo sapiens
taaaggtttaaatttctctaaccaaactgcttgatccagatgcaggactgcaaatgttaatatttgttctggaagaacaatcaaataagacttaagaggaaaaggaatggccacaatccacctgaaattttttttttaaaaagtgtgcagcctactaaatcagaatgaaaatagaagtacaagattataaacaaaatgcaatcaaacttttcttaagcttacctaaagttatttcatctgaaaatttcaagcaacttgttcaacattaaattgacaatctaaactaacaagtcttttgaatttatgcatggtagtaaacattctctctattaactttattacctaaggctaaacctaaaatttttaagcaaaattagaaaaatagtcttcactcatcaaaaaataaagtttgttacatttagtattttcccaataaaattggtcgttcttggttttttatttggagagtctgtgcaaaatgtcactaaaaataaattagcactagaaattatttctaaataccaaaaaaaaaaaaaaattgagatgggtttcccaaggaaaacacacacaatcaaacaacaaaaacaaagaacaaaaaagaatagacaaaaaga

SEQ ID NO: 902 - DNA, 600 bp, Homo sapiens
  misc_feature 377: n = A,T,C or G
gcatccagttgacaagacatttaaggtgtttatcaggatcatgccctggccccagcttcccaataccagctgttgaaaagattctctctcatctggagagaactggagtgcacagttcacccacgtggctccgggttattagttactgtgggctggtcttggtcagaggcatctgcagctggagtcacagctggacttgcagtggacgtggcagtgtctggggaggcctgggatggtcttggagggggatcgcttgctgagacagactggaaatactgcacagtccaggcgatcaatatggatagcagaaaggttcccagaaagtagatcagggctgagtgcaggatacaccccagagaagccgcaagtgcaggtanagccaggccaaggagcaggggctgaaggactcctcgttactgtggctccagacctttcgtacagtcctggagatggagatgtattagatggagattgagtcatttcaagaatccagatatggtgtggatatcggacatctcgatagcaggacagttaaaaatcctggagtctcatcaggcggctggcgtaattgacaacactcagtctgtacggttggtgcaa

SEQ ID NO: 903 - DNA, 5040 bp, Homo sapiens
agagcagcgttggcttcgagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcggctcactacaagccttgacctccaggactcagtctccttgtggaccaccacccttctgttatgacattgccacattgccacagattgatgcttacacaccatctcttttggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagatctccaaacgaccgaagatcaaggtgtcccttatctcccaaggggacacagctggagggtcttgtgctccttcccaaggatgtgctccagaaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcgctgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaaaaaaaaa

SEQ ID NO: 904 - DNA, 935 bp, Homo sapiens
atctgtgatcaataatactaatatgttatcttttaccgtattctgcctctcactatgattttaattagttaggagtatttgagctgttatttcttgagcttaatatttttttagagttaactctttaaggagataatcatggctgtagacaaggccaggctggctgacgtgccttagaaggtttgaatgcaataaagcggtgttggcgttctcctgcattgtagtgcgggtacaaaatgctattgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagctttgataaggaattctcagaccgataggatgtctgtctgggcttgctgcgggacagtctaactgtgggggctaggggaaagcaggagagtatcgatcaaagagtaagccacacacggataatcagttaatagggatggaggtgtgagggttcattatattattcattttactgttgtatatgtttgaaaatgtctataataaaaagctttaaaaaaaaaaaaaacaactcgagtttagtacataacagaaagtgatcagactctgtagaaaaaacatccttatcatcgccgtcacaaagagaaagccccgcatatttcggaggcccaggggcgcaacatctggcgccccaccttgggtatcgggggggacaagggggcctgggagggtccaccagaacagttgtggccagaatggtggacaagcctgggcgagaggggaccccagtttttgcatcgcggggaaaggaacaacgcgcctgaatggaaacacaccgagggtctgagaagcaggatgaggacagtgagaagca

SEQ ID NO: 905 - DNA, 6229 bp, Homo sapiens
agagacacgaatatgtttcagccgcaacaggctgcgtttcagccggaagagtgaaagggcaccttgaaaacgcaagtttatgaatatgtttctgtactttcagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggtcataactccatgcaggaagctcatcttgtgtgctgataacagaaaagaaatggaagattggattgcagcattaaagactgtgcagaacagggagcactttgagcccacccagtacagcatggaccacttctcagggatgcacaattggtacgcctgttcccacgcgaggccgacctactgcaatgtgtgccgtgaggctctgtctggggtcacgtcgcacgggctgtcctgcgaggtgtgcaaatttaaggcccacaagcgctgtgctgtgcgtgcaaccaataactgcaagtggaccacactggcctcgatcgggaaggacatcattgaagatgcagatgggattgcaatgccccaccagtggttggaaggaaacctacctgtgagcgccaagtgcactgtgtgcgacaagacctgtggcagtgtgctgcgcctgcaggactggcgctgcctctggtgcaaggccatggttcacacatcgtgtaaagaatccttgctgaccaagtgcccacttggcctgtgcaaagtgtcagtcatcccacccacggctctcaacagcatcgactccgatgggttctggaaggccagctgtcctccttcttgcacaagcccactgttggtcttcgtcaattcaaaaagtggggacaaccagggtgtgaagttcctcagaagattcaaacagctactaaaccccgcccaggtcttcgacctcatgaacggaggcccacacctcggcttacggttattccagaagtttgacacattccggattctggtttgtggcggggatggaagtgttggctgggtcctctccgaaatcgacagcctcaaccttcataaacagtgtcagctgggagtgctgccgctcggcacagggaacgacttggcccgagtactgggctggggctcagcctgcgatgacgacacccagctcccccagatcttggagaagttggagagagccagcaccaagatgctggacaggtggagcgtcatggcatacgaggccaagctcccccggcaggcctcctcctctaccgtcaccgaagacttcagcgaggattccgaggtacagcagattctcttctatgaagactcggttgcagcccacctttctaaaatcctcacctcggaccagcactcggtggtcatctcctcggccaaagtgctctgtgagacggtgaaggacttcgtggcacgggtggggaaggcctatgagaagacgaccgagagctcggaggagtcagaggtcatggccaagaagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaagtgtcgaaatctccgtgtgaaaagctgatcagcaaagggagtctgtccctaggcagttctgcttcccttccgccccagccgggaagccgggacggcctgcctgcgctcaacaccaagatcctgtacccaaatgtccgggctggaatgtctggttccttacccggtggctcagtcatcagtcgcctgttaattaatgctgatcccttcaactctgaaccagaaaccctagagtattacacggagaaatgtgtcatgaacaactattttggcattggcctggatgcgaagatatccctggactttaacaacaagcgcgatgagcacccagagaagtgcaggagccgaaccaagaacatgatgtggtatggagttcttggaaccaaagagttgctgcacagaacctacaagaacctggagcaaaaggtcttgctggagtgtgacgggcgacccatcccactccccagtcttcagggaattgctgtccttaacattcccagctatgccggaggaaccaacttctgggggggtaccaaggaagatgatactttcgcagctccatcattcgatgacaagattctggaggtggtcgccgtgttcggcagcatgcagatggccgtctctcgagtcatcaggctacagcatcatcggatcgcccagtgtcgcacggtgaagatctccatccttggggatgagggcgtgcctgtgcaggtggacggagaggcctgggtccagccgccagggtacattcggattgtccacaagaaccgggcacagacactgaccagagacagggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacagtatccgagaaatagctcagtctcaccgggacatggagcaggaactggcccacgccgtcaatgccagctccaagtccatggaccgtgtgtatggcaagcccagaaccacagaggggctcaactgcagcttcgtcctggaaatggtgaataacttcagagctctgcgcagtgagacggagctgctgctgtctgggaagatggccctgcagctggatccgcctcagaaggagcagctggggagtgctcttgccgagatggaccgacagctcaggaggctggcagacaccccgtggctctgccagtccgcagagcccggcgacgaagagagtgtgatgctggatcttgccaagcgcagtcgcagtggtaaattccgcctcgtgaccaagtttaaaaaggagaaaaacaacaagaacaaagaagctcacagtagcctgggagccccggttcacctctgggggacagaggaggttgctgcctggctggagcacctcagtctctgtgagtataaggacatcttcacacggcacgacatccggggctctgagctcctgcacctggagcggagggacctcaaggacctgggcgtgaccaaggtgggccacatgaagaggatcctgtgtggcatcaaggagctgagccgcagcgcccccgccgtcgaggcctagcctctgtcctctcagcctgtggcctccacatccccgccgccgaggcctagcctccgccctctcagcctgtggcctctgcgcctcctgccactgaggccctgggcagatgctgcagcccgcccccttctcatggtgctacttcctctgtcagctacagaaagcctccgtgacaccgtccaccagagctctggggtctcgaacataacaacacagctacctttgaaacaacactttctccagctcagagtcacctggggcacatgtgtcacggccactcagctctcgcccgcctgtgctgtgggccagggaatccagcggcgtctggcctcctgggcactgcttgcctggcctcgtgcttggattgtcccgggggctcctctccgtgtgtccttctgtggccgcaccgtgtggctccgcctcctggcccccagccagttctcagaaacgtggctggggcccagcacagcagcctgcaagggcccctgtttgttgatgcagcttttgttgaacaaaaatcgtgctctttcctggtttgaaagtagcatggatgtttccagtcttgttgattgtaatttgacgtgaagagaaaaaaaaattcctcctgcgtgagccaaggcagcgggtgctgtttcccaggcggggagcccctccctgggtgtcacagggcctgtgctcctccctcctccatcctctctcctcccgctcctccctccccccactgtgggctggggacgcctgcccttctgtctccggacgctctaggcgagttcagcttggggtgtgagtgagacagcttgccagctgcatccctgcagacagaggatgtgtgtccacatgagtgtttctgtgtgggaaatgcttcctggctctgggaaactttttctgcccattctgtggttcccagggagcgtggccctggtgggccaggggtggtttgacctcttcagcccgtccggtggcctggaggccggaggctctcctgagtgtctgcccctgcagtggcttcttgtcgcctgctgctgggcgtgatgtcgctggaggtgctggcagggactctgatttggtggtccgcgctgcccctgccctgcctctgtcctggctctgaactagtagatgatggtgccagagggcagggagctcgcctggggagagggctgtgccccgtagggacagtgcccaggtgaaggatgcccctggtcctccagggcactgactttgcccttttttcccgttgatagtcatggctcagaggtgcttgtaaatgtcttgggaagaggtttctgtaacccctgccctggtgtgaggaggaaatggctctggcctggctgcctggccgtggcttctctttggctcccaaagagaaggacagtgttgggagtatctgccgtggcttctctttggctcccaaagagaaggacagtgttgggagtatctgccggcgctgtccaggtcctttagtcagcgtcactccatctgatgtgcagaagctgggctgcacctgcgggggtgggcatagaccgggctgggtctgcagcagcccctggtcctgagcaggcggcagtgaacagcactggcccacctcccactcacagcccctctgtcccctctgcagtgcacccaggtgggcccctctgcgtgcctttgggtgctcccctctcgtggtcgttctggcccgaggcccttagagtatggaggctgagccaggccttgggtttccccagcacagcctcctgtcgctgcatgcgacgtgttgggatttttggatgaaagactctcccacgctctgttggtggacttagctgcctcactggaagtgatgtgggtggaaggtggttgtatgttaccttttccacctctcattgttttccccagaacattgtagatgggggttggcagagggagaaataagccagccacggcagtcgcttggtttcccaggtggaatgggctaacacaggagatgatgggaacctgtcccgcagtccctgcatgaccattggccctgctggcctggcgatgtgggcatcctggggttcttagggtcccagaacaagccccaggcaagctggaacttgggtggggaggggacatgaggaggataaacagctgactgtggcttcaaggacatcagggccaccccaagtcctcagtgtcctactcctggcaaggagttgggtttggatcaaaagtgtttaaaattaatatgttgtcagtgattagaacaacactgtttacataaaaaccatttttctaattctaacaagttagaatgtgaggaaggaatgaacatgagtgtttaggaacctgccctttggtgctgggctggcgtcccgcactggggtgtcctcgctgtctgggggctgctctgctgccccggcccaggtccccttgtggtgttgccagacgggcctcatggtctgctgtgcagagagaggcaggaaggatccctgaagagtcttggagaaaaggttctgtgccctcaggtggggcttaccccctcgtatttataatcttaatttatatagtgaccaccgtggaaacaaacgcctcttgtattgtcatgtacatagtccatacctgagtgctgtacataagttgttctgtgtataaataaaacaagcctgtttttgatcttcc

SEQ ID NO: 906 - DNA, 4569 bp, Homo sapiens
cggacgcgtgggcaggtcccgtcgccggtgagcacgggctccctctcgcgtggcctcgccgggtccgcctggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggtctggggtcctgaggctgctggcagactatgggtacaacggccagcacagcccagcagacggtctcggcaggcaccccatttgagggcctacagggcagtggcacgatggacagtcggcactccgtcagcatccactccttccagagcactagcttgcataacagcaaggccaagtccatcatccccaacaaggtggcccctgttgtgatcacgtacaactgcaaggaggagttccagatccatgatgagctgctcaaggctcattacacgttgggccggctctcggacaacacccctgagcactacctggtgcaaggccgctacttcctggtgcgggatgtcactgagaagatggatgtgctgggcaccgtgggaagctgtggggcccccaacttccggcaggtgcagggtgggctcactgtgttcggcatgggacagcccagcctcttagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccagcaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtg

SEQ ID NO: 907 - DNA, 6364 bp, Homo sapiens
ggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtaccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgc

SEQ ID NO: 908 - DNA, 8368 bp, Homo sapiens
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 909 - DNA, 3649 bp, Homo sapiens
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 910 - DNA, 1705 bp, Homo sapiens
  misc_feature 1, 14, 16, 22: n = A,T,C or G
ncaatcttaacttntngagaanaaaccaagtgtccgggattcagacctctctgcggccccaagtgttcgtggtgcttccagaggcagggctatgctcacattcatggcctctgacagcgaggaagaagtgtgtgatgagcggacgtccctaatgtcggccgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagactcctatgacagttttggggagccttcataccccgaagtctttgagcctcccttgactggctacccaggggaggagctggaggaagaggaggaaagtcaagggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaaaccagttccctacgaggagtgttcccaatgctttgtccatgatgtccttgttattttattgcctttagaaactgagtcctgttcttgttacggcagtcacactgctgggaagtggcttaatactaatatcaataaatagatgagtcctgttagaaaaaaaaaaaaaaaaaaaaa

SEQ ID NO: 911 - DNA, 685 bp, Homo sapiens
ccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggcgaagatgaaaatgaagagggcactgcatcagagcatgggggacagaacaaagaaccagccaagaagaacaggcacacataaatgaaatgcctgagttaatgtgacacacaacaaaacaa

SEQ ID NO: 912 - DNA, 948 bp, Homo sapiens
atggcggacctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacacaaaaaaaaaaaaaaaaaaaaaaaaaaaaaaaaaaaaaaaaaaaaaaaaaaaaaa

SEQ ID NO: 913 - DNA, 382 bp, Homo sapiens
ccttcaaaaaatattttattctgcacatttcctagtaggctctctgcccaccgttccagggtagcagctactcataacttgtctttctctccaaaaccaagagggccttcccaacagaaaaaccttcagttcccaaagcagcatcgattcttcccctcaccccagcaaacctcggggtggaataatgaatcattcaccttctcccacccctcactgccccgccccaccttcatttgccaggactgtcactggctgatggtcagattttggcttttttcaacttggataccctcaagcatcccagcttttggaggcttccctgggcaacctcatgggcttccacattgaccaggcattacattcagcatccttggacaaacca

SEQ ID NO: 914 - DNA, 1756 bp, Homo sapiens
acaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggagaaactgcaggtcaagggctgataacggccatgcaggatgcttgatgctgcgtcccccgctgcttgccgccccccaccccgccattttgtataataaagctccctgtgtattctcaaaaaaaaaaaaaaaaaaaaaaaaaaaaaaaaaaaaaaaaaaaaaaaaaaaaaaaaaa

SEQ ID NO: 915 - DNA, 856 bp, Homo sapiens
tccaccaccatcagatgcagttccctatttgtttaatgaagggatatataagctttctaatggtgtcttcagaaatttataaaatgtaaatactgatttgactggtctttaagatgtgtttaactgtgaggctatttaacgaatagtgtggatgtgattgtcatccagtattaagttcttagtcattgattttgtgtttaaaaaaaaataggaaagagggaaactgcagctttcattacagattccttgattggtaagctctccaaatgatgagttctagtaaactctgattttttgcctctggatagtagatctcgagcgtttatctcgggctttaattttgctaaagctgtgcacataatgtacaaacaaaaacacaacaaaagcattatttcaaaggggaaaattctacgggtgtcacacattatgggctatagtgtccatttctttaaagacagttatgccctttaaaggctttaaaaaagacggcctacctttgtttgcacaacaaaagttggcgtgattccccaacccccaaaaatatggtaattaacactttacctttcctgtgtggagttacacctcttttatgtgttcatttcgtaaaacggcggaaaaaaatcccctttggggtctcctaattttatacaacaacagggctttctaatttgtggacccctgtgtataacaagattttcggacgacactccggtgtagactgctacaggacttggcaatggcacacgtcaatgtcaacaaaatccggtttacaagaccacctgcgcttccctaaaaggtatttgaaccacaggtttggtcataagtcctaatttaaaacaacaatacagacaacata

SEQ ID NO: 916 - DNA, 2940 bp, Homo sapiens
gcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtaaaaaaaaaaaaa

SEQ ID NO: 917 - DNA, 4314 bp, Homo sapiens
ggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaaaacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaaaaaaaaaaaaaaaaaa

SEQ ID NO: 918 - DNA, 536 bp, Homo sapiens
tttttaaccttgttcagatttctttattgaaaaattaaagtcataagctctgtatataaatacaatgacactgctggtcacctgcaaggcctctgggataggctgggggtgcagagggaagctggggccttggggtccccaggggcatggggagggaaataaataataaacaccatgggggataaggagccaggaggaatgggggtgtgaatggggaggtgctcgatgcttatttgtggcactaaaggtcttgcaagatgccccctgactgggggccgtgtccatgaattctcgagtgacctcactttggacaaaggctcaggcatctggggatgggctgggtcctagctggaggggggacagcagtgcccccaacccaacctggagaaaccagcactctgcccttccttttcctttcttcctgtcttgcaacccacttgtcctgggcgcctactgtgtacccagtacagcaccagttcctgacctgaccttctgtctgccttgtcctgctctcttcctctcccagttctggtcca

SEQ ID NO: 919 - DNA, 2112 bp, Homo sapiens
ataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacccggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacttatcaagatgcatttattaggaaggaggagtttagagagcaggctatcagaataaccactcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagttagagtcctcaagccaaatagctaaagctgttttatcacaacaaaggcctagtttgttccatgagtgtgcatttcatttcttcagttaaagccttcagagacacacaataaaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgagtgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgataactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatcttatcattcgtcttcttttccaaactacacatcactgtatgactcaaccagtagcagttatattgccccttggtttttattcagtttaactactgtttccaagataaatgagctaataagcttt

SEQ ID NO: 920 - DNA, 5200 bp, Homo sapiens
gaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgccgcagcacaaggctgcccaggtcgccaaggagaaaaagaagaaaaagaaaaagaagaaggcagaaaatgcagaaggacagacgcctgccattgggccggatggcgagcctctagacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctg

SEQ ID NO: 921 - DNA, 399 bp, Homo sapiens
tttgcttgcacatcctctttttaatctgattcagatgaggactcagatgataaaggtttatcatcagggtaacttttctttctttttttgctgaggcttcttacatccttttctttctctgtttcatcctttgacttctttttcttttttacagactccttgctctctgattctgattcatgcgtagagctttgggatgatttgtatgaacggttcttctttttctttctcctttttccttgtttcttttcctcatcctcagaatctgaagaactgcttgaagaatcagagcttgatgaagaagatgaagaccgacaagatttcttctttctctttttctttctttctctttttttagatgagctctcatttccacttaataatttctctctgcttttt

SEQ ID NO: 922 - DNA, 4190 bp, Homo sapiens
caacctccagccagtccctgggtcgggcggatcctcccagaggtggcacaatggagcgatctccaggagagggccccagccccagccccatggaccagccctctgctccctccgaccccactgaccagccccccgctgctcacgcaaagccagacccaggttctgggggccaacctgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaaaaaaaaaaaaaaaaa

SEQ ID NO: 923 - DNA, 3595 bp, Homo sapiens
ggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctctcacctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgcctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgca

SEQ ID NO: 924 - DNA, 2388 bp, Homo sapiens
atcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaaaaaaaaaaa

SEQ ID NO: 925 - DNA, 41369 bp, Homo sapiens
gatcacgccattgcactccagcctgggcaacgagcaaaactccgcctcaaaaaaaaaaaattaaaaaacagagcttggattgcttcttagtcttctggctaagaatcaagtgtaaaacagcttggccagtgtgccggggtagggtcctgggagcccctggctgtgtcaagagaccccctttgggccaggtgcggtggctcatgcctgtaatcccagcactttgggaggccaaggcaggcggatcacttgacgtcaggagttcaagactagcctggccaacatggtgaaactctgtctctaccaaaaatacaaaaattagcccggtgtggtggtgcatgcctgtagtcccagctactcaggaggctgaggcaggagaatcgtttgaacccgggaggtggaggttccagtgagccaagatggtgccactgcactccagcctgggcaacaagagtgaaactccgtctcaaaaaaagaaaaaaaaataggagacccccttttactttccagactgtgggagggaggaagagtgttgtcccaggcagtaactaggggctagattattaacaaactagtattttagtgcctgctacacctgaacagtgcttctggctgaatgttagccctgggaatctgaagatcagagaggtggggcatcctacctgaggatgcacagcctggatcctcattttgccctgatttatccagatctgctgtcctccctgcaccctacagagcagggcaatcacagcagggggccccttcagtgtcctcagacagctgctgtgatttgaataaccaggcaggctgctggatgtcccctggtgactgatttgcctggcaaacagaccctcaacccctgggagacagtccccctggggccttgtttcttcttcctatcctcaaaagctccccaggcccatctccccttgcctggctctgcttggtggtcctagtgcttgtccacccctggaggctggatggttccctccaaaacctgggagaagatgggcaggtccccaggcaggggtaacctgagccagcttagtccactcccagggccagccaggaaatttgcatgaagagaatgaggttcctcagaggcttcccctcctttcccaccagggatagtcatcctggggctgaggtctgacagcaggtggaagcagcccctgtgtgtggagagccttccggagggcatgccccgcgccttcctggtcaggagtcggcgtccacagccccccaactggggccatctgcctgaccagctccggggagatgcctatatcccaggtgggcccctcactgtgcctggaggtaaggggcaggagagacgcagtgtcaccatctggcttttctcctcagactgcagcagcctgggggggccaccggcacaacagtcgtccagtgtcagggatccgtggacagcggtgagtgtgtaactggctagcaaagccagctgtttcgctcctgcctgctctcagccttaatgaagctgacagccccttgctcccccgacccatctgcacacgccctccagcctcgggacctgtccgcccctacttctctgtgttgggaatgcctctcctttcctagtagtgagctctctactgttaggtctcaccccaggcaccagggccggcagccacagggatctcttccagcggggcacaagattcatccccacatgtggatgatccgctttatgtcagaacatgggacaaggcaacaggagtgcgatgggagataagggctttttcagctgtgcatgcattggaggaaggaaagcgccagccggaatgtaatatattcatgaaagcaaggcactgttctaggcatgggctgttatattcagcgggaataagacaaaaatccacaattttatggagcttatattctggttggggctgcatgtatagacaataaaattagtcagcctgtaattccagcactttgggaggccgaggcgggtgaatcacttgaggtcatgagttcgagaccaggctggccaacatgttgaaaccttgtctctactaaaattacaaacattagccagacatggtggcacgtgcctgtaatcccagctcctcaggaggctgaggcaggagaatcagttgaacctaggaggcagggcagaggatgcagtgagccgagtctgcgccactgcactccagcctgggaaacagatctagactccatcccccctcaaaaaaaacaataaaattagaaaaatagaccgggcatagtggctcatgcctgtaatcccagcactttgtgaggccaaggtgggtggattgcttgaggtcaggaattcaagaccagcctggccaacatggtgaaaccccatctctacaaaaaataaaaaaattaactgggcatgtggcgcatgcctacaatcgtgtaatcgtggggaggctgaggcactagaatcgcttgaacccgggaggcggaggttgcagtgacctgacatcataccacttcactcctgcctgggcgacagagcaagactctgtctttaaaaaaaaaaaatgtgtatgtcacatcagaagatgggacttggcatagagaaagtaaggaccatgggatagtgagggaaggccctggagagtgacaggcacacacactaatcactgtctcccacctgccttcctaatcctccgtggtggctcaggacactctgtaaatactcatttgcagagtaacaaagggtggatggggtccagccagagaggctaataactcctgcatccctccagcagcccacacagggcaacctgacctctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactggtgagcagtggcagggacagggaaaagttgctgggccccaggtggggatggaaggaaatggagagaggtgctgggctgtggagtgtccatggtttgtgtatgtggggtatggagaatcaagacatgatgtctctcggaccccagtgggtgggtgtaaggtggcaccaaaataggggcctgtcacggaatgcagagtgcagacggatgccggttatacgattcaggctccagatcgaaaggcaagggaaggcctccctctccatcccccaggggagggagcatcctggtgagggagagtggagacacaggtgtctggcccatgtctgcactgggtgacggtagcagatggtgggtcatgggcggaagagtctgaagagcttggaataggtaccagaaatgctcaacactggaaagcagggtgggggcgctttagtccagagcccattgccctctctgtccagccctcccctctgcgcccatctgtgcagggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaagaacaggcaagagaacttcaccaataggtaagggcccggcagagttccaagaagcgcagggtcacccacattgatatccccgcccccagaaaggaccaaacaagccccagatacttagaaagccctcgcgccacttacctcggcccgcgcactgtgtgactggaagaacacagcctccttgtggccgcacctgagagggtaggggctcggtcaccggaggcttcacacccttccctcctcccttcgcccagtgaggagacgagcctcactttacctccccagtaccagctgaacgctcacttttggcacgggtggtcctcggtccgcggcaacgtggggtcctgggacacgtcggcgataatctgggtcagttcgctgcagggacgcgggggtgcaaaattacgctcagacccagcctccagagccaacacccccgcccccagctcagggcccgccactcactccacttcgtgcgtgatcttgttgacatagatgcagctgttgtcggcctcctgctggtaatcacagttccggcactacgagagggcgagtgtgggggaaagggggtcacggaaggattccagacaagattgggaggagagggcagggtgatcccggaggatatgacgacaggactctctttggggatgggcaggacatgagagtcaggatcacttgaggtgcagcggagggcgaacagggagtccgatcacagaggcagggggcagggcggggccacgctgggaacaggtggacctgccggggaagaccccggcgctcaccgcgtagagcagaatgcggttctccttgtcttccttggggtacagcatgttgttactgtggggagggggaggtgccaggggttagttctggagccattcctcgcccgccttctaacatcacccgctccctccgcctcaccattcctggcagaagcgaatacccacgaagcccggctcgtaagtcccgtcgggctccatggcgacgcgcagcccgcgcagccctcccagccttccgcgcttgctccgccgcgctacaggtcgcgggaggggccaggcctaggtgcttcgccaaaagagggcggagctgcgcacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaaggtgtggccatgggggcggggtccggaggggcggggcgaagaaattggggggttcccggaagggggaggctgggaggggccggggagtgactgggcgggcccggaggtgatcccaggctgcggaggctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtgaggactctctatctgggacactcccccaccccacctttcatttggttattcaacagacacttgctgggctttgccctcagtcatacccgagataggtcctgccttcgtggagcctccagtgcagcctgacgagagacagacccatcattagacagggacagcctagagtggtctgggctgggatcaggaaatcccaggggactggagccaccaagaagaggtgcctgactccacctgggagaatcagagagggcttcctggaggaagggatgtctgagctgagggatgaggaaagggtgacttaagagaaagaggtggaaaggagggagcagggtgtacagaggcctagaatgtgaggtaggtcacagtgagcgaccaggctggacagcttgggagaaaccagaacacaggatctctttgtgcatccactcagtacatcctttctgtctttttttgagacagagtctcactctgtcacccaacctggaatggagtgcagtggcactatcgggctcactgcagccttcacctcctgggttcaagtgatccttgtgccccagcctcccgagtagctgggattacaggtgcccacccagctaatttttgtatttttagtagagatgggtttttgccatgttggccaggctggtctggaactcctgacctcaagtgatcagctcaccttggcctactaaagtgctgggattacaggcgtgagccaccaagcccagcccctttctgtccttattccctcccgacctcactcagtctgtagcagccacattgctccttgcacagtccaggtgagctcggcctctggatcctgggcctgaatggttcttttgtcatatgcctgcgtgcctcacccttccttcctgtcttaatttaaagtgtcagtattctagtgaagtcttcaccggcctcagtgttaacgtttacctcattcctttccccttctttgctttattttagatttttgtgtttacaagtaattctcctctgacacactctggatttctctcatctggtttatttactctctgtctccctggattcgagtgccctgagggtggaaattttgatcactataattcactactgtgtccccagtacttggaatagtgcctgggacagggaggatagtccgtgaatcgttttttgttttgttttgttcgagacagagttttgcccttgttccccaggccggaatgcagtggtgtgatctcagctcactgcaacctctgtctcctgggttcaagctattctcctgcctcagcctcccaagtagctgggattacaggtgtgcaccaccacgcctggctaattttgtaattttgtattttaagtagagttggggtttcaccatgttggccaggctggtcttgaactcctgacctcaagtgatctgcccacctcagcctcgcaaagtgctgggattacaggcatgagccaccacgcccagccctgtgaatcattgttgaatgatgaattgaatccataaagtaagaccacaaggataatgtaattatccccattttgcagaagagaaaatttagcttcagggtggagtttatttatttattttttattttttttgagacagagtcttgctctgtctcccaggctggcgtgcagtggcatgatctcggctcactgcaacctccgcctccccggttcaagcgattctcctgcctcagcctcccgagtaggtgggattacagatgcccgccactacaccagggtaatttttgtatttttagtagagacggggtttcaccatgttagtcagactggtctcgaactcctgacctcaggtaatccgcccacctcggcctcccaaagtgctgggattacaggcatgagccaccgcacccggcccagaatctactttcttaaggatgaactgtcagtagcattttggccccagtctacatgactctagagagaactgcttcttttttctctcgttgattaactgttcattccccatctgtgttgtgccaggggtttcattatgactgcatctgagaagttctagtgtatgaggcagatgttggctaaatggccagaggactgaatgtgaagggtcaggggagacaagggttgtgtaggagatcatgaagctgggagaccctatcctggggtacctgatgcatcagtgacgtctgggaggacatcctggaggtggtgctgctggagcagagacgagaagaataaaaagaattggtcgggcatggtggttcacgcctgtaatcccagtgccttgggaggctgaggtggacagatcacttaaggtcaggagttcgagacggtgaaaccccgtctctcctaaaaatacagaaattagctgggcgtggtggcagatgcctgtaatcctagctactcaggaggctgaggcaggaggatcacttgaacccaggagctggaagttgcagtgagctgagatcacaccactgcactccagtttggatgatagagtgagatcctatctttaaaaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacaggtggtggaggacaggaagagtagggagaccaggaaggggctgctgtgagagtcctgatgaggggacgaggtctggagctgtgggtcaggcctctgctgggtgcacaggactgagcctttgggccaccctgggcagctgaagctaaggggtgcgggtgttcataggcacctcataggcagtggcatctttgagcaggtttcataacaggcggttcaggtacacacagacctcccaggccactcaaggaaggtgttccagagtggagccactggggaatttttacattttctaaaattctttttctctttataaatatcacccatattcattgtttaaaataacagaacttcaaatttgtgaaaattctcaacagaaattctcagtgacgcttcatccggaggtaaaggccattcctattttgccatgttagcccagtggcttaggccagacacctcagggtgttccttgggcccgctctctccctcacccccacatccactctcatcaaatcctctcggctccacctacaaaaacttccctgaccctggtccagcctccatccttcccccaacctcgccatcccggcagcttcctccctggcctccccgctccccatctcagccagagggagcctgggaccacctgagtcaggccagggccctcctagctcagagccctgccctggtggcacttcgctccagataaaaaccaaagtctaggccaggtgcggtggatcgtgcctgtaatcccacccagtacattgggaggctgaggtgggaagatcacttgaggtcaggagttctagaccagcctgaccagcatggcaaaatgtcgtctctacttaaaaatacaaaaattagccgggtgtggtggtgtgtgcctatagtttcagctgcccgggaggctgaggcaggagaatcacttgaatttgcagtgaggcagaggtttccgtgagctgagatcacaccaccacactccagcctgggtgacagagcgagactccgtcaaaaaaaaaaaaaaaacccaaagtctccagcagtcccttgtgtcttccactctccctctggctcgctccaccccacccgcaccacccactctagagcgtgaaggacatttctacctctggccgtctgcacctgccgttcttgctcatctttccagccttggctgaaacatcccctcttttgggaagcctaccctcccatgctccttaagcctcttccctgtcatatttttctccatagccatcctccagtgtttcataggtacctgttcctttgtttgtggttggccttctccctgcacaatgagcacagcctgagggcagagtgcgtctgtgtttacactgagtccccagcatgaggcccagctgggcccctgggagctcggaaaccaatgaatgaatgaatagtgggggcagaacaggaagagatgctctggggcctgaggttggggccagcttaggagagtcccagaggcccatcgaggagatgcgctgtgcacagggctgtgggcaaggcctgagctctgccggttggactctgtgactttggggcccttggcgatgttgatgccagcaagcggggaacttctggggacagaggcagcctctgggagcttggatgggggtgaggaaggggaggtggccagtgtacgtagctacttctcccttccgctgggctcaggagagaagagaaggctgcagtacaggcgagggagggagatgcgtttttcccagatggagacactgaagtccctgcacccagcacccaggcctccctggccagaccctgatccccacggagcccctcccctcacacaggtcattgaccacagtggcgcccgccttggtgagtatgaggacgtgtcccgggtggagaagtacacgatctcacaagaagcctacgaccagaggcaaggtacgggcaggtgggcgtcgaggggtgcgtgggggccagagggagtatgtgcaggtatgagggcgggcaggttagacagggcccctgcagggaggccagtggtgtagacggggggccgagagcttgggaggatataggggtgaggctgggagtggggacagacggaggcctggggtgggaatgagggccgggaggtgtcaggggtatgggcagtcagacgtggtcgggggagggctgggaaagtggagggagttgaggggtaggtgtgggggctgggtgttgtcagggtcagatgggggcatggggcggtcggacggggtgtggagggcaggacaggtggaatgcgagtggacagggtggcggtcagtgagggcgcctgggacggatcgagtgttgggggagaccgggggcctcagggccggaggagggcggaggaggaaggcggatgatgaaggcagatgtgcgctgaaggggtgagagaccatgggtcctgtagtgaggggtgcaggcggcaccccttccatttacgattgtggagttggggggcctaggagtcctgggagaggctaaggctgtggtgggagacctggggcttgggtgacagccctttgtcacctggaagagagagttcctccgtgaacgtgggcccctcgtgggtggagcgtcatcctgttaggcccggccgacaccccaactgaccccagccccctctgcccacagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcggtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatggctcacgcctgtaaactcagcactttgggagaacaaggtgggaggcttgcttgagccccggagttggaggttacagtgagctatgattgtgtcattgcaccctagcctgggcagcagagaaagacccagtctcaaaaaaaaggctgggtgcagtggctcacacctgtaatcccagcactttgggaggctgagacaggaggatcacttgaacccaggaatttgagaccagcctgggcaacataatgagaccctgtctctacaaaaaaaaaaaaaaaaaaatcccacaaaacttttgtcagttgtggtggtgagcacctataggtgccccagctacttgggaggctgaggtgggaggatggcttgagcccgggagttgaggctgcagtgagctatgatcgcaccactgcactgcagcctgggtgacagagggagaccctgtctccaaaaaaaaaaaaaaaaaaagatacacggggtacatatatgtattgttacatgggtgtgttgcctgctagtgggtggggaccgggcttctagtgtacccatgacccaaattgtgaacatcgtacccaacagataatttttcaaccctcaccaccctcctgtttctggcatccccactgtctggtatttccgtctttatgcctgtgtgtacccatcccccagtcgtcttcagccactaatttacgtctgtctctaatttgccgattctggatgtttcataggaataggatcatgcagtctgtggccttttgtaactggcgccttccactgagcagaatgctttcaagtttcatccgtggcatgcctgtgtcagtgccacactgttgccaaatagtcctgcattgagcgcctagaccacagtgtatccagtcaccagttagtggacattagggtcatttccactttttggctattatgaataatgctgctatgaaccttcttcttttttttttttttttttttctaatttgagacagcatctggctattgcccaggctggaatgcagtggcacaatctcggccatttcagccttaacctcttgggctcaagccatcctcccacctcggcctcctgagtagctgggaatacaggtactcatcaccacccccggctaaagttttgtggttttttttgtaggatgggatttcgccatgtggcccaggctggtctcaaactcttcccgctcaagtgatcgtcctgcttcagcctcccaaagtgctgggattacaggtgtgagccaccatgctaggcctgaacattcttttataaatttctgtgtggctgggcatggtggctcatgcctgtaattccagcactttgggaggccaaggtgggcagatcacctgagatcaggaattttgagaccagcctggccaacatggtgaaaccccatctctactaaaaattcaaaaattaactgggcgtggtggcgggtgcctgtgatcgcagctacccggaaggctgaggcaggagaatcgcttgagcctgggaggcggaggttgcagtgagccaagatcacaccactgcactccagcctgggcaaccatgcaagactccatctcaaaaaataaaaaatacatttttatgtggacatttgttttcatttctctgtgcctaggagtggaatccctgggccacatggtaacactgtgcttgacttttttgaggacctgccacactgcttcccacagccgctgcagcagttttcattcccgccagcagtgcagaagggtcccattttgtcctcatcctcaccagcactttagtctgtcttttgcttacagtcatccactgggtgtgaagtggaacatcatcatggttttgatttgcacttctttggcagctaatgatgttgagcatctttgcatggccatttgtgtatcttctttggagaaatgtctattcagatcctttgccttttgttttttgacacacagtctcactccgtcacccaggctggagtgcagtggtgctctcagctcactgcatcctctgcctcccgggttcaagcaattctcatgcctcagcctcccgagtagctgggattataggtgagcgctacaacacctggctaatttctgtatttttagtagagacagggttttgccatgttggccaggctggtctcaaactcctggcctcaagtgatccacctgagctggtggatctcccaaagtgctaggattacaaacatgagccactgcgcccatcggtatgtcggggtttggttttgttttttttcttttgagacgtaatctcgctttgtgcccaggctggaatacagtggcatgatctcagctcgctcgttccaacctccgcctcccgggttcaaacggttctcctgcctcagcctcccgagtagctggaactacaggcgcccgccaccacacccggctaattttttgtatttttagtagagacggggcttcaccgtgttagccaggatggtctcgatctcctgacctcgtgatccaccctcctcagcctactaaagtgctgggattacaggcgtgagccaccgcacccggccagtatgtcatcttttgagaagtgtgtgttcatgtcctttggccatgatcgtggctcactgcagcctcaacttcctgttgcccactttgtaatgggattttttttttgcaaagtgggtgttctttgagttccttgtatattcttctgctcagtttttcattgggatgctgtcttttgtcgctgagttgtgtattagtttgctaacaaagtaccactcactgagcaacttaaagttatttctcacagtaatggaggctagaagttcaagatcaagctgtcagcaggttggatttattctgaagcctctctctctggcaaggcagtagtgccatcccccttaggtttttacaaagccctcactggctggtgtcttcacccagtgaatgggggacaggggtggaagcagggacaccagtgaagtggctaccatattagtcccggcaggagctggaggtggtcctagtggtagcaatagaggtagcaagaaatggttttcaccaagacaggcttctactcaatgggtaggcatggatccagggtgatcctgaaatttcatggggatttcttctatgtccagaagcttcacagggatttctcttctgttggcaggtctcacagatttcaagcctggctactggattggtgtccgctatgatgagccactggggaaaaatgatggcaggtaacaagaattcccactcaggtgtctgtgtgtgcatttgtgtgtaagtccatgcgtgctgcttgctgagctgcccatgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatttagaggacttcatgatttggggacccactgggtaaatagtggcccttcggtatcaggggccagcctctgtctcctcatatcttgctgttcccccatcttctcatcattcccacctcatctgctgtagctaccaggaagaaagggaagggaagggaggggatatcctttgcctttaaaaatgatgtacagccagctgggcacggtggctcacgcctgtaatcccacactttgggaggccagggcgggtggatcacgaggtcaggagatcgagaccatcctggctaacacggtgaaaccctttctctactaaaaatacaaaaaaattagccgggcatggtggtgggtgctgtagtcccagctgctggggaggctgaggcaggagaatggcgagaacctgggaggcggagcttgcagtgagccaagatcatgccactgcactccagcctgggcgacagagcgagactgtctcaaaaaaaaagatgtacaactctggctggatgtggtggctcacacctataatcccagcactttgggaggccgaggcaggcggatcatgaggtcaggagatcgagaccatcctggctaacatggtgaaaccccatctctacaaaaaataaaaataaaaaaattagccaagcatggtggcgggcgcctgtagtcccagctactcaggaggctgaggcaggagaatggcgtgaacccgggaggcagagcttgcagtgagctgagatcacgccactgtactccagcctgggcaacagagcgagactccgtctcaaaaaaaaaaaaaaaaaaaaaaaaaaaagatgtacaactcagccaggcacagtggctcatgcctgtaatcccagcactttgggaggccgagctggcaggtcgcttaagcccaggagtttgagatcagcctggacaacatggtaaaacttcatctctacaaaaatgcaaaaaatgagtcaggtatggtggcgcatgcctgtagccccagctacttgggaggctgaggtgggagaatcacttaagcccagaaggtcaaggctacagcgagttatggcaccactgcattccagcctggatgacagagcaagaccctgtctcaaaaccaaaaaaaaagaaaagaggccaagcacggtggcccacgcctgtaatcccagcattttgggaggccgaggcgggagatcgagatcatcctggccaacatggtgaaaccctgactctactaaaaatacaaaaattagctgggtgtggtggcgcgtgcctgtaatcccagctactcaggaggctgaggcaggagaatggcttgaacccaggaggtggagattgcagtgagctgagatcgtgccacttcactccagcctggggacaagagtgagactccgtctcaaaaaaaagaaaaaaagccaggcatggtggcttatgcccataatcccagcactccgggaggccgaggagggcagaccacttgagttcaggagttcaagaccagcctgggcaacatggcaaaaaccctgtctctacaaaaaatacaacaacaacaaaaattagccgggtgtggtggcacgcacctgtagtcccagctacttggaaggctaggtggtaggatcacttgagccttgggaggtagaagctgcagtgagctgtgttcacaccactgcactccagcctgggtgacacagcgagactccatgccgtgacaccagcacgtggcgtgtcacattattaaggattatacagccaacagttactgggctggtttcctttaatcctcacagcaggccctgtccgcaagtctttcaccgtttcccgtcaacactccacctttcctgcccaaagtttggggttgggagggaattcccaggggttcccaggacttgggctcgcctcccagatcccgcaacctttgcgtgcctagcctcggcaatgaccgcccatctgccacgagggggcggcagcgcaccgttcagacgctgcgcccctggtgcattatgggtcgcgtagtctcaaaggtggcataagcatcctggaacgcaaacggcatttcccagaaaactacgcgacaatctgagcctggtcttgcccagagctggaagctgaggtctcgcccctgccggcgttgcgggggattgtgggatgtaggcatttggctccgcgctccgcgaagggcggtgcagcgcaggcgcgggcatccggtacagacagccgagcttaatctgaggcggggaaccagcgtcccgggggaggcgccgaagctgactttctggccgcagtggaagtgaggcgagcgagctcccttagtggctggagccggctgggcctccttcctgtcctcctgctttcctgcatctctacttgtccctttccccgggctcctggtccgctcccaagcctgttcaagcacgaggcgtttccatctaaaaaaagaaaagaaatctcttttgccgggcgagatgtcagagccccgggagcgaaagtgttggtaatgttagacagaatgagttcctcttcaaaaatctaacttccttgtcctttgctctatgaactgtccttcctgcagaaactgcccttaccggggaaactgcccctccccgccgctgcaacccataccccgcctctattagaaataggcaatcggaatcagcttagattgtgaggtccaaccctagccaacgggggttaaaaacccctgctctcctttattaggtgtgcttttggtacaggtctgggcagcacgcttctgcagaagtaaactttgccttgctaagaaacttttctccgagtgctggtctctctctgtggcaccaagaacttatttctaacagtaagaagaatttactgaggacagcgtaggcttgaaaaagaaaagttttactagaaagaatgctgccgggcactcacgcctgtaatcccagcactttgggaggccgaggcaggtggattgcctgagctcaggagttcgagaccaacctgggcaatacagtgaaaccccatctctactaaaatacaaaaaactaactgggcatgccagcatgtgcctgtagtcccagctacttgggaggctgaggcaggagaattgcttgaacccaggaggtggaggttgcagtgagctgacatcatgccactgcattccagcttgggtgacagaatgagactccatctcaaaaaaaaaaaaaaaaaaaaaaaatgaaggaaagaatgctgcaggccaggcagggtggctcacacctgtaatcccagcactttgggaggccgaggcaggcgaatcacctgaggttgggagttcaagaccagcctgaccaacatggagaaactactaaaaatacaaaattaggcgggcatggtggcccatacctataatcccagctacttgggaggctgagataggagaatcgcttgaacccaggaggcggaggttgtggcaagccaagatcacaccattgcactccagcctgggcaacaaaagcgaaactccatttcaaaaaaaaagagctgatttttttgtttgttttttagacagcgtcttgctctgttatccagcctgtgtgtgatcccggcggtgtgatctgagctcactgtagcctcaacttcccgggctcaagtgctcctcccacctcagtaggccccatgaatagctgagactacaggcacatgccaccacacccagctaatttctgtattatttgtagaggtggggtttcgccatgttgctcaggctggagtgcagtggcacaatctcggctcactgcagcctcaggctcctgggctcaagcaatcctcccacctcagtctcccaaagtgctgggattccaggtgtgagccactgcgcacggccaagaataaagattttaataaagtaatgtgaaattaacatgaaaagccaataaggaaactgggcaaatatttgaaaagacaatacataaaagaaacaccaatagccaaaaaaccatgaaagccaagttcacccccattcatatttgaagaatgttacataaaatattgagacaccaccttttgcctgtcaaatcaggaaagatgtttatttttattttttatttttgagacagggtctctctgtcatccaggctggagtatggggcacaatttcgtctcattgcaacctcaaactcctgggctccagcgatcctcccaccccagcctcccaagtagctaggagcacgggcacaccactatgcctggctaattttttcaaaacacttttttgtagagatggagtcttgctatgttgcccaaactggtctcaaactcctgagctcaagtgattctcccacttcagcctcccaaagtgctgggattataggcataagccgccatgccacaaaattttacaagaaaatttcagccagcatttgacaagattccaggggacatgaatgaaatacctaaagataaaagagttccttgaggccagttaaggtggctcatgcctgtaatcccaccactttgggaggccaaggcagtggatcacaaggtcaggagttcaagaccagcctggccaatatagtgaaaccctgttttactaaaaatacaaaaattagcctggcatagtggcgggcacctgtaatcccagctactcaggaggctgaggcaggagaatcgcttgaacttgggaggtagatgttgcagtgagctgagatcacagcaatgcactccagcctacagagcgagagacccctctcaaaaaaaaaaaaaaaaaaaaaggagttccttgacaaaagaaatgtggaatttgctgccttgaactaagttaaattagctgctttgttgcaggaattttcattaatatgctagtccatgataacctgtataaaaggatcctcttgggcattactttctgggttttttgtttgttttcagaaacagggtcttgctctgtcatccaggctggagtgtcatggtgtgatcatatatcatatctcactgcagcctcgaatttctgggctcaagctatcttccagcctgaacctcctgagtagctaggactgcaggtgtgtgccaccatgcccagctaattaaaaaacttatttttgtacagatgaggtctcattatgttgcctagagtggtctctattcctgggctcaagaaatcctcccctctcagcctcccaaagcactgagataacgtgtgtgccactgtgcttggcctgaattttttattttaaaatacattttgtgagctgtgcttagtaatgcacacctgtagtcctagctacttaagaggctgaggcaggggcatcgcttgagcctaggagtttgagaccagcctggacaacacaggaaaaccccatctttacaaataatcaaaaaattagccattactcgggaggctgaggcatgagaatcgcttgagcctgagaagttgagctgcagtgagctgtgattgcaccactgcactccagtctggctgggtgacagagcatgaccctgtctcaaaaaaaaaaaaaaaaggaaaaaaaattattcaacaacagttgttaaagcacaggaagggctgggcacggtggcttccgcctgtaatcccagcactttgggtggctgaggcaggcagatcacatgaggtcaggagttcaagaccagcctggccaaaatggtgaaaccccgtctctactaaaaacacaaaaattagctgggcgtggtggcccacacctgtaatcctagccactggagaggctgaagcatgagaatctcttgaactcgagaggcagaggttgcagtgagccaagatcacgccactgcactccagcctaggcaacagaacgagactccatctcaaaaaattaaaaaaattaaaaatagaataaggcacaggaaaggaaggctttattcagagccattacgatagagagaggggccacagtggcagggccttgcagtgagggagacaggttgggctcaactccaaatactgcatggggaagtgggaattcatagcccaggatcgggtggggcgcagtggattgaaagttactaagaggaaacatcaggggtaaggggggattctggctaaaccagcctaacaggattcttgctgaagacaggcccaggtgatcagacatcacataggggctggtggaggatgaggaacctaatcagatgttgaagatgggagagggttctcgataaactgacttagcagggttctttgctaaaactggatttgacaagggagtacacagatgagcctagcagaagattcagagacttgactagtttggccatgcaagaatttcttttttgttttgtttttttctgtttgttttgttcggctcactgcaacctccacctcctgggttcaagcgattctcttccctcagcctgtggagtagctggaattacaggtgcctgccaccacacccggtttgtgtgtgggtgtgtgtatttttagtagagatggggttttgccatgttggccaggctggtctcgaactcctgacctcaagagatccacccacctcagcctcccaaagtgctgggattacaggtgttgagccacctcgcccggcccaagcaaataatttttatcagggaattgactccaaagaaaaacaataggagaggaggtcctgcagggtcacagcccatacaagagtctggccgcaaggaagcctggtaagaggagagggaacagagcggtgctgacctgctgaagggaaggcagaggtcggacaggtacccggattagtcatcacataacaacttggcatcagccatgctctgccatctactgtgtggcctcaggcaagtgactcactctctctgaacatccacttcctctcatgttggtttctttctcagaggcttgtgagaggccttggcaagccatggccataaagcaatcactggctgggcatggtccctcacgcctgtaatcccagcacttttggggcaccgaggtgggaggatcacttgaggccaggagttcaagaccagcctgggcaacatagtgagacctggtccttacaaaaaataaaaaaatgattcaggtgtggtggtgcacacctgtagtcccagctactctggaggctaaggtgggaggatcccttgagcctaggattttgaggttgcagtgagctataattgtgccactgccctccagcctgggtaatgaagtgagaccctgtctcacttttttttttttttttttttgacatggagtcttgctctgtcaccaggctggagtccagtggtacgatcttggctcactgcaacctctgcctcccgggttcaagtgattctcgtgccacagtctcccgagtagctgggattacaggcactcaccaccacacccagctaatttttgtatttttagtagagacggggtttcaccatattggccaggctggtctccatctcctgacctagtgatccacccgccttggcctcccaaagtgctggaattacaggtgtgagccactgcacctggccaagaaaaaaatttcttgcttatacaaagtcagctgtgggtctgggtgactatcaagagcagaagtgctcgatgccagggctcggccctcttccttcatgtggcacctccaggtttgctcagctcctagtgtgacccgggcaggagaaaacagagcatggagcattctgcactgccttcccctgcgcccgccataaacacaaggtcttgctctgtccactgggctggagtgcaatggttgcactggtttttaaatgcttctacaaggagcatttaaagtgttctacatccaacacttctacttacattttattggccaaagtaagtcagataactcctgagttcagcagatcctgggagatggcggagggcattagtaatgcttgccctactgtctcactgctggtgctgaaaatccaatgagaaaatacacacaaaacatattcattcattcaacaaatgtttactgggcacctatgatgtgccaaccactgttctaggaactggatacatacctctgagtgagtacatagcagtgaacaagacatatagaaatcccagtccagccgggtgcagtggctcacacatgtaatcccagcactttgggaggccaagcggatggatcacctgaggtcaggagttcaagacaagcttggccaagatggtgaaacaccatctctactaaaaatacaaaaattagctgggcgtggtggcgggtgcctgtaatcccagctactcgagaggctgaggcagagaattgcttgaacccaggaggtggaggttgcagtgagccgagatcgagccactgcactccagcctaggcaacagagtgagactccgtctcaaaaaaaaaaaaaaatagaagtcccagtccgtggcaagctcacatactagcggaggagacagaaatctggatcaatatgtaaagtacacagggctgggcgtggtggctcatgcctgtaatctaagcactttgggaggctgaggtgggtggatcacctgaggtcaggagttcgagaccagcctggccaacatgatgaaaccttgtctctactaaaaatacaaacaaattagccgggtgtggtggtggacacctgtcatcccagctacttgggaggctgaggcaggagaatcgcttgaacccaggaggtggaggttgtagtgagctaagaccgtgccattgccctccagcctgagcaacaaaaatgaaactccatctcaataataataataataataataaaacaaaaaaaaaagtacacagtacgtgagcgggtgataaaagacaggaccttcccgtgatcactagatgtgtagacatgaaagatctgcttcccagacctggggctggagaaggtcttggtaagggagtggtggcctcatgtcttcatgtctgccctgagagaggctgtttggatgttgctgtgcttgcagggcctccatgctgagttttgtctctgttcagctgggaacatgcaggtgaccttgccaggcaggcatcttctcactttctccagggcgaagagatgagggcagggaggtgacaggacagatcactaggggtggctgtcatgagaactttaggctggagtgcagtggtgcaatcaaggctcactgcagcctctacctcctgggctcaagtgatcctcccacctcagcctcccgagtagctgggactacaggcacatgccaccatgcctggctagtttttggtattttttgtagagatggggtcttgccatgttgcccaggctggtctcaaactcctaggttcaagcgatcctcctgcctcagtctcccaaagtgctgggattccaggcatgagccaccgcacctggccctgttgtgagaacttctgactctttcctggagtggggtgcagccagggcagggctctgagcctacagggccctgacctgactcaggtggtctcaggcttcctctggctccacaagaggagcagacagcagggagcagacagaagggagcaggctgtggggtgtccaggtgggaaaggatggaggctgtggcagggtggggacagtggaggggaagagtttagtttctgtaggtggagccaataatatctgctgacaggttggagtgggtgtgaaggagagaggtgaaggaccaccccggagtgtttggcctcagtcactggaaggacagagctgccactgacctaggtggggaaggtagtgagggagcaggttctggaggaaggtcagaagctcagtttaggatatgtaaagcttaaaatgcctctaagggccaggtgcattggctcacacctgcaatcccagcactttgggaggctgaggcgggtggatcacgaggtcaagggattgggaccatcctggccaacatggtgaaaccccgtctctactaaaaaatacaaaaattagctgggcatggttgcgcatgcctgtagtcccagctactcgggaggctgaggcaggagaactgcttgaacctcagaggtggaggatgcagtgagccgagatcgcgccactgcactccagcctggtgacagagcaagactccgtctcaaaaaaagaaaagaaaaagaaaaaggaaaaaaaaagcctctgagatcttccatcctttcccatggaaatggtgaatatgatgcaggatgtaggagcctggagttcgcaggaggtgtctgggctggagatagaaatttgggggttagggttagggccaggtgcagtggctcacgcctgtaatcctagcactttgggaggctgaggtgggaggatcacttgagctcagagttcaagaccagcctgggcaacacagtaagacctcatctctacaaataattaaaaaagaaaaaagataaaggaaatttggatgtttgccgggcgtggtagcttgtgcctgtagcagtagctattcaggaggttgaggcaggaggaggattccttgaggccgggagttacaggctgcagtgagctacatcacatcactgcattccagtctgggtgacagaacccctgtctctaagaacaacacaaaaaactgggcgttggccgggtgctgtggctcatgcctgtaatcccagcactttgggaggccaaggcgggtggatcacaaggtcaggagatcgagaacatcctggttaacacggtgaaaccccgtctctactaaaaatacaaaaaattagccagcgtggtggcaggtgcctgtagtcccagctactctggaggctgaggcaggagaatggcgtgaacccgggaggcggagcttgcagcgagcagagatcgcgccactgcactccagcctgggcgacagagtgagactccatctcgaaagcaaaacaaaacaaaaaactgggcgttgatagcctagagacaggatttaagctgtgcatgtaggggaggcaccccatggcatgagtggtacagagaggaggatagagacctaacacctggggctgccgggaataaggggttgggggccagaactagatgacaatatggttacgattggcagtgagtgccatgagaaagtacaagtcattttgaaagcatataactggaagcctcacctagtctcaggttgggtggagacagggaggtctttctggaagagatgactcctgaggtgacacctgcagcctgagtagctacacaatcaggccagaaaaaaaaaggcagcaggggagttcctggccgagggcatgagggctggcagcaagtgagcctcgggagagggcagagagctggagcagtcagtctggcagggaggggtgtggtgagaagggaatctggattagtcatcaccaaaagatctgtgccaagcccgggttcagatctggttctgccaccctccgtgaccctgcctttcagaatctccattctctctcctgccctgcagacaaggcttgtgtagcagttaccttggcctggccccagcaaggcctcaggaaacatcagctgcaactagttttgtctgttgtgatgttgttatttgacctattatattaattatattattaacgcataagggtagtggttaaggatacaggctagggagagtgactgcttgggtttaacctcagagtcggtttacttatctgtaaaatggggataataaatagcatctatgtcacagggctgttaggagaacaagggaactgatggacgtcaagcacttggaggagtggttgatggttacttgtttttgtatcttttttttttttttgagacagtttcgctcttgttgcccaagctagagtgcaatggcacgatctcgagtcactgcaacctctgcctcccgggttcaagcgattctcctgcctcagcctcccgagtagctgggattacaggcacacgccaccacgcctggctgattttttgtatttttagtagaaacaggatttcaccatgttagtcagggtggtcccaaactcctgacctcagtgatctgcccacctcggcctcccaaagtgctgggattacaggcgtgagccaccacacctggcctgtttttgtactatttaaggaagactaagagtctaccagctgaggaatacagctggcctcgaggctgagggaacagcatgagcacagacacagagctaatgggggcatttacaaagcatttatcaccaatttatttatttatttattggagacggagtttcactcttgttgcccaggctggagtgcaatggtgcaatcttggctcactgaaacctctgcctactgggttcaagcgattctcctgtctcagcctcccgagtagctgggattacaggtatgcaccaccacatccggctaattttgtattttttagtagagacagggtttctccatgttagtcagactggtctcgaactcccgacctcaggtgatctgcccgcctcagcatcccaaagtcctggggttattggcatgagccactgtgcccagtatttatttgagacagagtctcgctctgtcacccagattgtagtgcagtggcatgatctcggctcactgcaacccccgcctcctgggctctggtgatccccccacctcagtctctagagtagctgggactaggcgcatgccaccacattcagctaatttctgtattatttgtagagacaaggtctcactatattgcccaggctggagtcaaactcctgggctcaagagatcctcctgcctcagcctcccaaaatgcagggaatacaggcatgaaccacttcacccagccaccacttaagttttttttttaataatcagtattgctgcagatatcatttaattttgatagggggcctagtggtatggagcaacccatgttcccattttacagatgagaaaatcgctgctcaggaatatcaagccactcttttggggttgtgcagttattacagggcacagccaggattcaactcaagcctagccagcctgcagggtaggggataagagccagccagcctgcctgggggccagatttagctccccccgatgagtcctgaaaaagtactggactcccgtggctcatgcctgtaatcctagcactttggcaggccgaggcaggtggatcacctaagatcaggagtttgagaccagcctggccaacatggtgaaaccccgtctctactaaaaatacaaaaattagctgggtgtggtggtgcatgcctgtaatcccagctactcgggaggctgaggcaggagaatcgcttgaacctgggaggcagagactgcagtgagctgagatggcgccactgcaccccagcctgggcaacagagcaagacgctgtctcaaaacaaaaaaaaaaaaaaagaaaagaaaagaaaagaaaccaggctatgtaaaaatattattgtaaaaaattaaattaaatcaaaaaaaggccggtagcccatacctgtaatcccagtacctcacagtactttgggaggctgaggcaggaggacggcttgaggcccggagttcaagagcagcctgggcaacatagcgagacctccgtctctattatgtaaaaacaataatattttttaagtaaataaagaaaccaggccgtggccaaaggaatcttcctgtgtctggggccttctttagaggctagcatactgaggacactctttgggccagtccaggaaggaatgattctggtggcccctgactggggcgggggcgtggtaaggttcgcctgggaggcggcgcaggcgctgcctgcggtttgactgccatccgggctgctgcaggcactgggaaaggcaatccagcctcaatcctcgccacagacacgggcgactgtcccccagcgtgtgagtcaaaccatactccaggcctccaggaggtgtttgtcgcgacaacacctgcagagggcccgtgcggagtcccttagtgagcggaccgaaaaccgccaccctggaaggatattggcatgccctagggtgaaaattcacactacgacactcggggggtgggtcccctccgagttctcgtccgcgggtgcctccacccagacctgaggggtgtcgggaagacccccgcctaccgagtcagggcgggattaagacctccggcgctggaaacgcgtagggcggggcccagacctggatccagctagccgggcggtgtggggtgcgcatgcgcaatgtccgcttcggctctaggaccgcgcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcggtaagcgcccggcccgtaccccctccgcaccccgcaactccgactttggcggcccccagacccggcgaaaccgtgaagtctcggcctcaggagccccccagatccatggtctcagattcgaaccctcagacctgttcgatctccttttatgccgtcccggggacccttctccaccctctgtctcatgatccaaaatacaggcccataggtttcagagataccctgtgaattcttccttggggtgtcctgaaccgcgatcgtagatctgtgcccccagttccagcggggaaccccattgtccgggaacccagagctcacagccacgatcttagacccgagcccacagagccagaggtgacactggaatcctgccgctgggaatacctaaattctcaagcccacatttgggatttcctaaaccccgccctggggccctttaggccgtggatgtttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaaggtgcggagccaatgcgtctgagtgacattttacggaaggggcttgacttatgagtgtggtcagaggttttaggtgggttaatgaggaggtgagcccaggaggaagcaagacctaatggggtagggtaaatggcccagaatgggctgggcttgctgggaactggctggattaatggagaaaaatgccctggtagggatagggcaggttggcttaattagccacggccacttagcagtgatcccttgaaggggcggggaccaatggctggggtaggatgttgggaagacgggcatttaggaagcgggccatggagtagggtcttgggcagatggcacctgaggaggataaggccttgggaagctggggcagagcctctatgaagtgagccctccaaggggcggggtcttttgattctacgtgggattttttaggtttagggtggccaagatgactgaaatctgccactgggtaggtgtgcctggcaggaggggagcctcccaggggaccggtctctgggtttcctcgagggtggggttggcctgaggaagggagaagaggggcacgaccagggcagtgtggattgggacagatgaggacaagaacaaatgaaaggcacagcaaccaagtaaggaagataacggctggggtctggagcgttggggctgatggttctgtagtgctgcccgttggaggccccgcccctggcactaacccctcccccttatctcttcgcagcgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaacattgaggccaacgagagtgaggaggtccggcagttccggagactctttgcccagctggctggagatgtaagtaacctggggtccctggccccgtcctaaccgttccatcccttcccttgtggctgcccttgcacacacacccttgaccatgacaatcccagtgttcccattctccatgacattctcagacccctttcagtcacccctgacctgcccctaacttccgcccgcaggacatggaggtcagcgccacagaactcatgaacattctcaataaggttgtgacacgacgtaagtgaccggggttaaggaatagggtagattcagaggcagaggggtcagagaggatttgacctctggcctctgactttcaacctgttacccacagaccctgatctgaagactgatggttttggcattgacacatgtcgcagcatggtggccgtgatggatgtatccttgggggcagtgtgggagaggccctgggtggacagagagttttttgagagtatgtttgggaagccaacatgtagctttcatatccacagatgtggaaatgcattcatcagaacacagtcacctgcagacatgtggcggtaaatcataacaatgccagctgtcacagctggcactttaattatataaagtgaccgaaccgtcataaccaccctgttggacaggcacaattattatattccattttacagaagaggaaactgaggctcagtttcctgaaagaagcagtcatttgtctcaagttatagataaaggtcaggcatggtggctcatgcctgtaatcccaacactttgggaggctaaggtgggcagatcacctgaggtcaggagtttgagaccagcctggccaacatggtgaaaccccatctctattaaaaatacaaaaattggccaggcacggtggctcacacctgtaatcccagcactttgggaggccgaggcgggcggatcacgagatcaggagattgagaccatcctggctaacacagtgaaaccctgtctctaccaaaaaaaaaaaaaaaattagccgggcgtagtggcgggcgcctgtagtcccagctattcgggaggctgaagcaggagaatggcgtgaacccgagaggaggagcttgcagtgagccgagatcgcgccactgcactccagcctgggcgacagagccagactctgtctcaaaaaataaaataaaaataaaaataaaaataggccgggcgccgtggctcacgcctgtaatcccagcactttgggaggccgaggcgggcggatcacgaggtcaggagatcgagaccatcctggctaacacggtgaaaccctgtctctactaaaaatacaaaaaaattagccgggtgcagtggtgagcgcctgtagtcccagctactcgggaggctgaggcaggagaatggcgtgaacctgggaggcggagctttgcagtgagccgagatcgcgccactgcactccagcctaggcgacagagagagactccgtctcaaaaaaaaaaaaaaagaaaaaaaaagaaaaataacaataacaaaaattagctgggcgtggtggtgcacgcctgtagtcccagctactcgggagtcccagctactcaagcaggagaattgcttgaacccgggaggcggaggttgcagtgagcagaggtttcgtcactgcactccagtctgtggactcaggtcttttgggcttgagaacccacgtttataacagccacatgcgcatatacacacacacacacctaagagcacacccacatacgtgaaggtgtatgaggcagtgtgcacagggacacacgtgttatctgtacatgggccagccattagctgatcttggatacatgcatatttttatttatttttgttttaaaaaatattttatagagaaaagctttcactatattgacctggcaagtctcaaactccagaccttaagcaatccttccgccttggcctcccaaagtgttgggattacaagcttgagacactgcgcctggcctcatgcacatttaacacatagggcaaacagacacatacataatatacatgtcatgtaatcacagacatattgcatagagcaaagcaatcccaactctacctcttaaccaggttattgaaccgctctgtgcctcagtttctctctctgtaaaatgggtgagtgataatggtgataccgaatcggaactacatccaaaaggtttagcacagtgtatagcgcatagtatgtggtctgtacacattagctcttaactatgatcttgggtagagttttcagctttgaatgttttcttctctggaaatagtcctggtagaactggtgtcccaaggatttagtgagaaagtgatgttcctgagtggacatcaggtggatcctgagttcaagcgatccacctgccttggcttcccaaagtgctgggattacaggcatgaaccaccatgcctggtcacacacttgtttttcacatatcctaacatttttatgaaattgagttactgtcaagaattttcttttctttctctttttttttttttttttttgagacagagtctcactctgtttcccaggctgaagtgcggtggtgccatcttggctcactgctaactccacctcctaggttcaagcagttctcctccctcagcctcctgaatagctgggattacaggtgtgcgctactacagctggccaatttttgtatttttagtagagacgggatttcatcatgttggccaggctggtctcgaactcctgacctcaagtgaaccgcctgcttcggcctcccaaagtgctggattgcaggcgggagccaccgtgcgtggcctattaagaattttctgaatgagcaattaacaactcttcaggcaaggaatttgtactttagagtagttgaatataattcctcatggttatgtttaaagagaatccctatttagaaatgtaagtgacaatatgtatggataaaatgaaaaataaaaccgcacaccaggtgatatgactaggaccaagcgggagctggagtttcagccctggctgccctgcttgctgtatcaccatcgtgtccacagtgcatgtgatgcatgcatctgggtgtagctgtcactcttcttaacaccctcccaccagagcgacaccacaggcaagctgggctttgaggaattcaagtacttgtggaacaacatcaaaaggtggcaggtgtgtagaaacctctgaaatccctggcacccagacccccaagccatggagacactatgccccacaatgctcacttggacccaatgtctctgtcctcacaggccatatacaaacagttcgacactgaccgatcagggaccatttgcagtagtgaactcccaggtgcctttgaggcagcaggtatggctggcagggacatgctggggctgggagtgggatgggtgagaaaacctctactcagctggtctgggcctgactcctgggcatgggagtgggttgggccatgtggcccccgcacctgaaggactacatccatcttagggttccacctgaatgagcatctctataacatgatcatccgacgctactcagatgaaagtgggaacatggattttgacaacttcatcagctgcttggtcaggctggacgccatgttccgtgagtgacaacccagctgtcttcctgggtggggattcctatgacctctatggaccaaggtctcctctaagcctgactttgaggtgggcgatgctaggggcacagtggtgattgaatcagttccagtttctgccctcatggagctcacagtctggtggaggagacacaagtccccagacagtgacagttcagactggtgatggctgggagaggggaagctcagggcagagtgatgggttgtgatgggggcagcacaggccgagggtctagggctctggtgaggggaagagtgagcagagcgtgctcagattgtgcttggggaagcctagagggcaaatccaatccaggaggaacctgatgcagcccaaggggtcagggagggctcactggagagggaacattgagacctgaggggatgaggagagaacttagtgagaaggtagggaatactgttgcaggctgagggaacagcctgtgcaaaggcctagaagggaaagaagatggggcttctgatgctttttgttagatttctttctttctatttttttgagacagagtctgctgctcttgttgcccaggctggagtgcagtggcatgatcatggctgactgcagcctcaactcctaggctccagcagtcctcctgcctcagcttaccgaatacctgggagtacaggcacacaccgccatgcctggctaatttttaaaattttttgtagagacagggtcttgctatgttgcccaggctggtcttgaactcctgggctccagcaatcctcctacctcagcctcccaaagctttggtgttacaggcatgagccattgcatgtggccttctgagtgttagtgtactgaatgctgaagacatggctgggaagtggggattactgtccttattttgtgaaggaggaacttaggattcaaggaggcaaattttcatgctcatagtcacccagctaggaagttgtaaagccagaatttgaacttggatctatctgagatctgagctaagtaagagaaggtaggagcagtgagcatgattaggtcatgcaggattgtgggtgccaagtttgggggtgctcaaactctaccagagacattggggagccatggcaggttctaggcagagggaggacagggtcaggtttggctttagaaagatcccttggcctcggctgggcacggtggctcacgcctgtaatcccagcactttgggaggccgaggagggcggatcacgaggtcaggagttcgagaccatcctggctaacacagtgaaaccccatctctactaaaaatacaaaaaattagccaggtgtggtggcgggcgcctgtagtcccagctacttgggaggctgaggcgggagaatggcatgaacccaggaggcggagcttgcagtgagctgagatctgccactgcactccagcctgggtgacagatcgagactccgtcttaaaaaaaaaaaatcccttggcctccaggccgggtgcagtggcttatgcctgtaatcccagcactctgggaggctgaggtgggcgtaaaacctgaggtcaggagttcaagaccagcctggccaacatggcgaaaccccgcatctactaacgatacaaaagttagccaggcgtgggggcgtgtctgtagtcccagctactcaggaggtttagggagggagaattgcttgaacccaggaagcggaggttgcagtgagcagaggtcatgccattgcactccagcctccaacctgggtgacaagagcgagattccatctcaaaaaaaaaaaaagaaaaaaagatcccttggcctccagagagcccacaatgcatgaaaagtaacagaggaaaagaagcaggtatgtgagatagcagggaggtgaagggagtggacagacaaggttgatgccacaagtcacataagaggggccaggaaatagccactggatctaccagcaagaaggctgatagtcgggaggatcatttgagtccaggagtttgagaccagcctgggcaatgtagtaggactccatctctacaaaaaaaaaaaaatatatgtatatagacatagccgggcatggtggcacatgcctgtggtctcagttgctcgggaggctgaggtaggagaatcacttgagcccgggagggtgaggctgcagtgagctatgatcttgccactggactccagcctgggccacagagacaccgtctaaaaaaaaaaaaaaaagggctgggcatggtggctcactcctgtaatcccagcactttgggaggccgaggtgggcggatcacctgatgtcaggagtttgagaccagcctggccaacatagtgaaaccccgtctctactaaaaatacaaaaaaattagccaggcgtggtggtgcacgcctgtagtcccagctactcaggaggctgaggcaggagaatcacttgaacctgggaggcaaaggttgcagtgagccaagatcgtgccactgcactccagcctgggcaacagagtgggactctgtctcaaaaaaaaaaagaaagaaaggcagccagggtgtgcaggacgctgtgggtatggacacctgagggtggtggtaactgagcggagatagtgtagtcatcatgtctagattccctgtgggtggggaacatggagtcaagtttcagggcaggcgtggggacctacctgtaagactctaggggcaggaagtagagtgtgcagagcctccctctagtagcctgttaggcttagaactggagaggatggagcatagatgtcagtaggaggctggggctgggcagaggtgatatcagtacacagaggccattattgaggagggtaacagattggattccaatcctgatttcttcactttcttgctatgtgacctggggcatggcccctcccttcctgcctcatttctttttttcctgtttttaatttttagtttttttaaaaagcagagatgaggtctctgttgcccaggttggtctcgaactcctgggcggctcaagtgatcctcccatcttggccttccaaagtgttgggattataggtgtgagccaccacgcccagcctgtgcctcattttaaaatgacacttatctcacagagttggattaaatcagccaatacctggaaagcactttaccccatgcttggcacacagtaaatactcagtgaagtgccagctgctatgattgtcatcccatgtatttgtgtaatgttattatgccaaaaaccagtctccttccttccctgccgccaaacctctgcatctcctcctccaggtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctatgggatctgcctcctgatctgacccgagagaggaggggtggctcgggctctgggtcctggggagcaggggaggtagtagattcgtccccagggctggatccgtggatttcctcgtctttttctcgtcggcattttttgtctcatcctgagctgtggaggctgagacaggacccagaagccccagtgatctctgcttctgcttccagagtctgggctggagggaggtctcaatgccactcctggccctgtcccccaaggccatgtttgcccctcttgcagcttctccatccacacttggcctctgcctctgttgtgtcatggaccatgctcagtgtcttccttcccacttgaggacaccaccccacgtccccgggtcccgagggggagcctatgggtgctgtttggggtactcagcagagggctgagaggtagcaacatcctaggagtatccctggtccagcatgaggcaccgagggctgggggcagtgggcagtccacagggcagagatccctggctggtgggaggatgggcttggtggggaggggtggacacaaacacagacacacacagaggccagcgtttattgacacttgttcaagtctctcaggccccccaggcttcttggtcttaattcctggggaaggaggcccagccaagggagtacaagctgtagacagtgcctagaaaggggaagcgttggagacagaatgagacctaatcccctccctggacatcccaggcttttaaggccttcaggctccctggttcccagcctggaccccagctctagttcggactccagctcccttcccagattggactcctattgtaaagccccctggctttgatctagaccgggctgggagctttctccccgactcctccctgggcctcagccccaccactaacccagcccccgtcctgggacaagagcccaaaccctagttactcccctccctgcaggcctgactccagctcagtactcgacccccttcctaaacgccaacccccaacccagatc

SEQ ID NO: 926 - DNA, 749 bp, Homo sapiens
  misc_feature 613, 626, 717, 720, 721, 733: n = A,T,C or G
atttcatagtatttctattagaataagagattagatttgttaaacatctaggttaaaatggttaaaaggattttcatacaattttaggcactatacacgttgtttacaacagcattggtacttggatatggggaaagataaatccgacattttaatatcttgatcaatttgtgacattcaaaataattccatttaagaaacattaatcaaaacttaaagagacataccactaagtatcccacacagtatactgaaaataaatatagaaatacaaccagaagtctacagatcaccacagtagacagactggtgaagccccagctatcatggcagtgaagggctctggctagatttggatgtcaactgctgagttctacatgaaaagcaaataataataataaaataacatgatgtacactctctgatgctcattttcatagcagcaaagcatgcttcacatgcactgcctgtgaaggatctcacaaggctccctcctagagagaaagtatgcccagcaagaataaagtaccaccaaatgtcaaagaatcccgaaaatacaggcagacagccagtcatggagcaggaacagcagtgcaattgtaagaatgactanccacattcaccanaatttcacttgtattcagcctggcacaggtttgatcatcagcatacacacaaatagccccaagcacaaagccaatccaccttagggaacantanntagtatagatanagacagtatattaaaa

SEQ ID NO: 927 - DNA, 3010 bp, Homo sapiens
gagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagta

SEQ ID NO: 928 - DNA, 842 bp, Homo sapiens
gataatgattagtgttatttatggattagaaaaagcatgtttctatttaagtaagctgtaaaaagtattattgaatatttactgtaaatatatgttcacataaaaaaataacttggagggtcttgtgtccctggcatattatcatcttcatggaaagaatccactgtggtttccgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcgtttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctatagaatcttctgactgtcctgtaattcatttcttaaggctttaacttggaaggtatcgtaacttgccggcattgatgtttagcaataaaagaataatgtgtaccaggcctttatgtctaaagacacaacaacaacaacaaaaaaattttgcgggggccgggccccgaaaaattttaaacacacctgttgggggcggggccaagtgtatgtgaaccggccaggtccagagagacgggccaaacggggggggtcccaaaaagcggggcggggtctggacccacggggtgcggccggcaacaggcggca

SEQ ID NO: 929 - DNA, 801 bp, Homo sapiens
tgcacgccggaccggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttattagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggcaaaaa

SEQ ID NO: 930 - DNA, 1855 bp, Homo sapiens
ggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaagaaaaaaaaaaaaaaaaaaaaaaaaaaaaaaaaaaaaaaaaaaaaaaaaaaaaaaaaaaaaaaa

SEQ ID NO: 931 - DNA, 1451 bp, Homo sapiens
actgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagct

SEQ ID NO: 932 - DNA, 5510 bp, Homo sapiens
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattggttttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgtt

SEQ ID NO: 933 - DNA, 837 bp, Homo sapiens
  misc_feature 344, 512, 780, 791: n = A,T,C or G
gtagttgtaaaacagatttcattgtgttatacatcacttataaagaagcatagttcccattcttccacatgatgctttttgcagcattgtaccacagaataatgactccctaataactcagctgaaaaatatttagatctacttgctctaagaataaggtcaacattaaacattctcagatgaaaagcttgctggatgaaatagtgcaccatcagaataaagcatgcaatatatttacagtcagatgaaacaagtgtgtccataaatcaaccaaaagaccatctcctcctttaggaaatacatgtattgcttagccagtaccaataagttaacgtcgtgtgaantaatttgggtattctggccttcctgaatctcatacagccaaaccaaccagaaggcttccccttctggtttgtggtggcttatcatttggcatctggaaacttctcttattttgctggataattgctggctagtggtgggctactgacttgcctagaaaaaataagtcnatcattcagattaatcttggaggcgtatctaaaatccgatttatttagatagcttgattggggggctagtagctcatttctaaagaaaaactctactgtggaggaaaaccctgtggggcctccttttgtggtgtttttttcccaaaaaaaaaaaatccggcgcgcgcgtcccatggagagatacactaccccacaatttttttttttgtgttaaaaaataaacggaatagggggccgtgggttttctcccgcctttttcgggggcctnaaaaaaagggncttgcggttttaagactacctggttggaaccccgttttttggcacc

SEQ ID NO: 934 - DNA, 1202 bp, Homo sapiens
gagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgaaaaaaaaaaaaaaaaaaa

SEQ ID NO: 935 - DNA, 4264 bp, Homo sapiens
atttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgatccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgaccaaaggtggtaaattcagacaacattatgatctaataaactttattttttaaaaatga

SEQ ID NO: 936 - DNA, 1009 bp, Homo sapiens
ggagactgctccccgcccgctcgggcccctgaggagccagtgcccccgcggcacttctgggtgccaggtgcatcctagcccgcccgaggcccctgccaccccccatgggggtctgggcccggctcgcctgccctcctgggccagtcaccccctcccccagcccacccaaataaaggattatttaacgtgtcatgagatcaggcctaacggcagcccaatcaaccatcccaaactgcaggggccgtcccacggcttctggaaaaagacaacccagctccgagggggcaggggcttataggaggggccgaagcagtgcagatgcaccatattcaagccactggtggaaaggcgggggacaatggcaaatgtacactaaccttcaaatgtgccttcctgtgctcacggacaaaagagagcgtccggaccaggggacggattccatggggggatccaagaggccaggacgacgactgaggaaaaggcccagccactgaagcatacagacagacacaaacgtgcacacttgaaatcctggaacactggacagcaaaactcacatgaaacagctgactgcaaggaattctgtgataagagacataataaaaagtattaaaatctataactcaaggtacacatcagttcagagacgcaacactgaagtaacatgtcaacaaaacacaagcctagaccaaaaaggaagcgaaagcatggactgagaacggcccgagtagcgaccacatgaggcaacaatagcactgggcaagcggcacacagtaggaagcagaggacgaccacgaaccaaaggtaactagggatatggaccaccaggaaacacagggagccaagagaaagacagacagagaacaaagacaaagaacaacaagatagaagagcacactaggagacaaaagaggacacaagaaaagagagggagagaacaaaaacaagaagagacggcaggagacaacaaataacacgagacagacagaagatcagcgcgcgcgaaaaa

SEQ ID NO: 937 - DNA, 918 bp, Homo sapiens
cttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcacagtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattccccctcaaacctaaaaaaaaaaaaaaaaaaaaaaaaaaaaaaaaaaaaaaaaaaaaa

SEQ ID NO: 938 - DNA, 2795 bp, Homo sapiens
atcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctata

SEQ ID NO: 939 - DNA, 1159 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 940 - DNA, 2430 bp, Homo sapiens
cccggccggtgagcaacggctctgcggccatggcgagcggcgagcattcccccggcagcggcgcggcccggcggccgctgcactccgcgcaggctgtggacgtggcctcggcctccaacttccgggcctttgagctgctgcacttgcacctggacctgcgggctgagttcgggcctccagggcccggcgcagggagccgggggctgagcggcaccgcggtcctggacctgcgctgcctggagcccgagggcgccgccgagctgcggctggactcgcacccgtgcctggaggtgacggcggcggcgctgcggcgggagcggcccggctcggaggagccgcctgcggagcccgtgagcttctacacgcagcccttctcgcactatggccaggccctgtgcgtgtccttcccgcagccctgccgcgccgccgagcgcctccaggtgctgctcacctaccgcgtcggggagggacccggggtttgctggttggctcccgagcagacagcaggaaagaagaagcccttcgtgtacacccagggccaggctgtcctaaaccgggccttcttcccttgcttcgacacgcctgctgttaaatacaagtattcagctcttattgaggtcccagatggcttcacagctgtgatgagtgctagcacctgggagaagagaggtccaaataagttcttcttccagatgtgtcagcccatcccctcctatctgatagctttggccatcggagatctggtttcggctgaagttggacccaggagccgggtgtgggctgagccctgcctgattgatgctgccaaggaggagtacaacggggtgatagaagaatttttggcaacaggagagaagctttttggaccttatgtttggggaaggtatgacttgctcttcatgccaccgtcctttccatttggaggaatggagaacccttgtctgacctttgtcaccccctgcctgctagctggggaccgctccttggcagatgtcatcatccatgagatctcccacagttggtttgggaacctggtcaccaacgccaactggggtgaattctggctcaatgaaggtttcaccatgtacgcccagaggaggatctccaccatcctctttggcgctgcgtacacctgcttggaggctgcaacggggcgggctctgctgcgtcagcacatggacatcactggagaggaaaacccactcaacaagctccgcgtgaagattgaaccaggcgttgacccggacgacacctataatgagaccccctacgagaaaggtttctgctttgtctcatacctggcccacttggtgggtgatcaggatcagtttgacagttttctcaaggcctatgtgcatgaattcaaattccgaagcatcttagccgatgactttctggacttctacttggaatatttccctgagcttaagaaaaagagagtggatatcattccaggttttgagtttgatcgatggctgaatacccccggctggcccccgtacctccctgatctctcccctggggactcactcatgaagcctgctgaagagctagcccaactgtgggcagccgaggagctggacatgaaggccattgaagccgtggccatctctccctggaagacctaccagctggtctacttcctggataagatcctccagaaatcccctctccctcctgggaatgtgaaaaaacttggagacacatacccaagtatctcaaatgcccggaatgcagagctccggctgcgatggggccaaatcgtccttaagaacgaccaccaggaagatttctggaaagtgaaggagttcctgcataaccaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagttaaaaaaaaaaaaaaaaaa

SEQ ID NO: 941 - DNA, 1478 bp, Homo sapiens
gtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacttgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataa

SEQ ID NO: 942 - DNA, 1781 bp, Homo sapiens
agtcgcttttgttctcgcgatatttccgggtacgcgggagccccggcgacccgggcttctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctaaaaa

SEQ ID NO: 943 - DNA, 569 bp, Homo sapiens
tttgaattttatctttatttctccataagggcaatcagagaaatatgctttcctttttaacaagctcatctttaatgtggtagcaaagatggaaggtgcgagaccaaatcttaccaaactagctatttttacaggccaataaagcaacatgcaatccccctcaacaaatttaaataatcaggcaatactaagaatgtatattccattaaactaaaataaacaaggttgaaatgtggtacagaattcactgatgagcctgtgaactccacgtgaggatgtccagtgccttatttatctcagtaaccagagtacccagcacacaagataaaagtgggtattacctaagtggccactattttattaataatgcacataacatatgcttatcattaactcttaaaaagattattatttaactatacaagaactaccatacaacatttcaacatacaagttcctatacttcttaagatacacaataatattttgaaagattggaaatgtttcccaaggactttcctatcacaaatcccgcccagtaaaaattataggaactgtggaatatggct

SEQ ID NO: 944 - DNA, 756 bp, Homo sapiens
aaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcgggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattaccttttgtgctgttcccttcgtacaccaatgccagtgctcgagacacaccattaaccttgttccacacgttccgggactacctcccctaccacattaagggcctttaaggcctatattcacacacgtatgcgggcgaaaacgtttgactttcttaagggg

SEQ ID NO: 945 - DNA, 2522 bp, Homo sapiens
ctcccagggcatagaattactgagttagaagaaataactggtttatttttacataggatgtgatgtctaatattgtactaaaaatgaggatgcttatgctatactccactggtactatccactggatttatttattttttttattttttgagacggagtctcgctctgtcgcccaggctggagcacagtggtgcaaacttggctcactgcaagctctgcctcctgggttcacaccattctcctgcctcggcctccagagtagctgggactacaggtgcccgccatcacacctggctaattttttttgtattttttagtagagacgggggtttcaccgtgttggccaggatgccctcgatcttctgacctcatgatccacccgcctcggcctcccaaaatgctgggattgtaggcgtgagctaccgcacctggctgtttttgtatttagatagagtttaagtgcaaagtaatctgctgatttaaggttgttttaaattcatatctgaggaataaaggatggacaggcaatttccatccctttgatgttccataattctagctatttatatcattcatttgccccttcagcatggattggcttacacctgtaatacgttccagaatagctggatttcttttgttttcccatcggtgattttcatagagtagatgctcaatgacatataatgcagaaaggccaaaaatagaggtaagtaaagctatgaaagaaaagaagaacgaaagaggaagcagagtagtttgattttgtttattgctgcttaaaccagagagatatgttattctggaagggtgatttgcttgtttttacacatatgcagcctgactgttttaggcttggcttcttttttgtttgtttgagatggagtgtcgctcttgttgcccaggctggagtgcagtggcacgatctcggctcactgcaacctccgcctcctgggttcaagggattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcccctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatttccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtg

SEQ ID NO: 946 - DNA, 2535 bp, Homo sapiens
gcagaccgggcgtcgggtgagcccagaagtgagagcagttggctgtgccccagtgctgtgtgacccagaggcgccgctcaccctctctgagctggtggacatcatagcgggtgcagcccaaaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctcaggtggcctcctggcctttcc

SEQ ID NO: 947 - DNA, 521 bp, Homo sapiens
ctttttttttttttttttttttttttgaagataaccagcatctttatttttcatgcttccttaaatagttttgggagtaggagacttgtcctttggaagattgtcatccagaggcccaggaaagtcatctccaccaagagagccaactccctgcctcagtgtggtgttcagctggaagggggtgaacccagccaggccccaagagctgtcccagcaaagcccccgataactttagatgtcacagagagtccagctgcccctgggggagaagagagggtgagcacagggcacagggaggggtagcagctcctaacagggggttgaaggccagagaccctggtccctccagagacctgaggcccaggcagtccaaccctgttccccacctctgcttcctaaaaccctaggatttctgctctgggaggggctgctgcaggccactgcccgaagaggaggcaagaactctggtgaggaatcccagcaacagggcagaccctctgagaaatggcaggttccttatc

SEQ ID NO: 948 - DNA, 3549 bp, Homo sapiens
ggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaata

SEQ ID NO: 949 - DNA, 1475 bp, Homo sapiens
gccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagt

SEQ ID NO: 950 - DNA, 953 bp, Homo sapiens
agtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatcaaaaaaaaaaaaaaaaaaaaaaaaaaaaa

SEQ ID NO: 951 - DNA, 2061 bp, Homo sapiens
gccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcgtgtacacttggctgtcaggctttctgtgcatgtactaaaaaaggagaaattataataaattagccgtcttgcggcccctaggcctaaaaaaaaaaaaaaaaaaaa

SEQ ID NO: 952 - DNA, 14131 bp, Homo sapiens
gatcgtggaagcctccaactccagcacagggggggcccgcactccttggtgcctccgcagtcttcgaacagacggggaaactgaggccctaagaggcctaaagcctacacttccccgcggaatgcggcgggcgcgggcgggttaaaggggcggggccggcgctggcccagcccgcggctccccccagcgccctcgccccggcgctccctagcccggcgcggcccggcagcgagagcggcgccatggaggccaccggggtgctgccgttcgtgcgtggcgtggacctcagcggcaacgacttcaaggtgagccgggccgggcgcgtgccgggcctccctgcaggccttctcttccgcccggcccgcttggcctccgcttcctgtcccgctcggctccaggccctgcgtgtcccagggactgcggccggggcggggtggggctctcccctggccaggaatggacctccgaggcctccgcccagtgcctgtacggggagaccgaggctgggcaggccggggacggacgcttgggctcggagtcccgccgggggcccggccgggagcccccaccccgcgtccgtgttctcggtctaggctggatggtggcctggggatcgggcgagcctccccgcccctctgaggtcacacgcccaagccaggccctgactcagggatggctgcccggctgcccaggggcgggtgtggagccgactcatcactgccctctccccgccaccgccacccgccatactgtgtgatcctgggcctctcagatcacttcccctctcagagcctaggctttctcagccggtgaaggggcttaaaagtctcctccttggacgcaaggagtatagtgagatttgttggtgtggagagtgtgtcaggccggtgtgccaggtgctgggtggcagttgtctgagcagctgctggactgagagaaaagggaccggagcccagccctccgcagccagtgggtggggcggcggggtggttccaggactcaagaatgagacaggcattgcctgaccaaaggggaagcagagaaagagagggagggagagctggctggagggtcagcctcaccttcagggtgggtgactggcagggtcggcctgggttgttggtctggggctggggccgaggaggcaggtttttcctgcgtttacctgcctgtgtacacacctttgaccccaagtacaagtggctacaccacttttccctgaccccatccccaccaccctaacctggggtccccgttcctctttgctgaactgggagagtccgagtcaccagctgggaatgtggcgctagggggaaaggaatatcagccgcaggcactgaaggcacctactgccccagacttggtgccacaagggctggaggtgccgaggtgggcgttcacacaccaggggagtgcagtgatgctggcctgccctgcagggtggggagccacggtctccgcaagcaagggtttgaccctggccgtgagttgccagtgtgctgatggcaggatgagggcacaggtggcgcctttgcaaaggcttggaagggggatcccccaccccaggcagccagtcagagtgtggaatgctaggtgaaggaatttgagccgagctaaccacagagccggatgctgggctttcacctgaaacaagccagttttgtcctggccctcctggggcccagaatccagtaggagagacaaatcttaggccaacacttttgtcacgggggggcttaaaattcccattctatgggtgaagaaattgaggcacaatgatgaaatgacttgtctgtgttctcacagatggtgagagttggttctgtggctccccaaaggctcccatgggctggaggagccatagaaggtggtgagcaggggctctgtgcttcaccttgacatccttcccccagggcggctacttccctgagaatgtcaaggccatgaccagcctgcggtggctgaagctgaaccgcactggcctctgctacctgcccgaggagctggccgccctgcagaagctggtaagggggtttgggcgggcaggggagggtccctgtggatgagccaggtgggcagagcctgtggagaaggcagacaacttctccagagagaggaacaccgacagctatgagcagagctggaagaaagggagtgggcaccctgtccagggaggtgtgcaagaagaggccgggtgagtgagggagggaagctgcaggggtagttgggccagtgtggctgaggccttcctggatggtgcagagttgtggaggcaggcagggactctggacaccccacccaccctgctgagcctgtgctccccattccggcccaggaacacttgtctgtgagccacaacaacctgaccacgcttcatggggagctgtccagcctgccatcgctgcgcgtgagtgctggccgggaggccaccgagcttggggttggggccaaggtccggtcagggacgtgaagcctgggctagacaccaagctgggccagcatttctgcccacctccgtgtcaggctcagaggctcaggtgtcacagaggggccctctcattagaggttacagcagtgccctgtgtaaagtaacccatgtggatcagagaattccatcaggaaaaaggtaaagaaatccaaaatcttaccagccgttatggacaataactacagtaataatagccaagactggctgagcaatgttcccactattctgttaggattttttcatatgctctagccctccactaatgttgcagaagagaaacttggccaccaaggcagattacttgccccaggtcacagagccaggcagtggtagagctggtgttgagtggggtttggccgggagcaccgtgtaccttctacccaagacttgaacgtcccagaacatcaggcccttggccagaccctgtaggcctcaacgagggccatcccatctgaagtcagagccctggagatgtttagggcacagcttctgacttggactctctgagttcaaagctgggctttgccacttcctggtgatgtgactttgtacaaatcgcttctaccttctgggcctcctctgcaagtgcagtggttgggaggggcagcagtgaccccgtgaagcagcagcagggtgccgcacaggcattcagactggagaagtggcggggcagctccggtgactcccgttgtcacttggagtcacgacaccattctctggccctgttccctcatgctcaagctttctgcatgtctgtaaggtatgaggaggtgtcagtcttaagttagggagagaaagcagacttcctctccatccagattctgatttctctgtggtccacttctctccctctgttctgaaaaccctgactcagaccttacccctatctcaccttctggaattaagaagaagagaaatggtttgaacagaaaaggttccctgagggccctgtgctggggctccggggcacatttgagctgggctttgaggcatgaataggagctcactgggaggctaggaagagcgctccaggagagggagctatttgatcaaaggccagaggtgagagagtcctcaggcctggcctctggtgagctgcctgaggaggtgtccctctctagactctgttccttcctgagagtggaagccaggaattatagactcttatggtttattcccaggccatcgtggcccgagccaacagtctgaagaattccggagtccccgatgacatcttcaagctagatgatctctcagtcctggtcagtggctacccactcacctggcccctgtgctagccggaccattcaatccccactcactataaaagtccctggggccattgttatcccattttgcagatgggaaaactgagtcttggagtggataataccttgcctgaggtcacttttggagtcagatccctaacacaggcactcttcctcccaagtccctggctgtctccctttggccctgaagccccctcatctacccccacacccaactcagtgccctgcctgatccccaagcttggcagacgcctggtggggaggagactcccctgacctgggtcttgccccttctacccaggacttgagccacaaccagctgacagagtgcccgcgggagctggagaacgccaagaacatgctggtgctgaacctcagccacaacaggtgccaggccagtggggggcagggggcaggtgggccctgtggggtggctggtgctgactcaggtggctcctgctccccacccgtagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggtgggcgccccctcggaccgcactcctgcagaagccaccctgaggagtctggccgggccccttcacttcccagggccctaacccttctcccttaggcccagccatccctccgtgcaggcagcacccctcagtgtacaacctcctaagtatcatgtccacctctcagtcctgtcttcccgcttacacaccccgcaaccacccttgggcttgtcccttcaaccagatgtgacctcacacctaccctctgggccctgtgcttttggtcctgccctgccaagccccacccttaacactccctaggtgggccctggccctgaccactcacgtcaccctggcaggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggaaaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgcccgtgcgtctgaggccctcagtagggggatgggaggaaggccgtgagcctggccctgacctcccacccctgcccgttccccctccagtcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgctgggcagggctggggctagcagaggcacttgcagcacagagaaccccgggatcgtagtcagagcccaccttgtggtctgtgcaagtcagacaaaatgaagatgggttaattcaccttttcttttcttttcttttcttttttgtttttgagacagagtctcgctctgtcgcctgggctggaatgtagtggtgcaatctcggctgactgcagcctctgtctcccaggttcaagcgaatctcctgcctcagcctcctgagtagctgggattataggcgtgcgctaccacgcccggctctttttgtatttttagtagagatggggtctcaccatgttggccaggctggtcttgaatgcctgtcctcaaatgatcagcctcccaaagtgctgggattacaggtgtgagccaccacgcccggcccagttaactcacctttgtggatgaagaccacagtcccatgccagccattcccaacttgagcccctgagagcacccttcggggggcactgttagggacaaggccacatgacgtgggaacgcagtgttgcttctctccccttctggagatcacagtgcccgtaacatggtctcttggctctgagaagtccttcaggcagagaatggagacccccgccagttcctctgaccctacctgcctcccctccccaggactaggggttttcttgcccacttccccttgtctgtcacctgcctgaggccctggctggccctgtcttcacaggtgcccaaagctgaggaaacttgtcctgaacaagaaccacctggtgaccctcccagaagccatccatttcctgacggagatcgaggtcaggcatgctgggtttgagagggctcaagagagacaagcaaggggtgtgccctggagcaagggggacccagcagaggcctcctgagggaggtggccagtgccagggtgcccgtggggagaaggtgggccccacctccctgcatccagagtacattccacagtctcatttaagcccccagccagccccagaggtgggtgggaggagaacccagttccctgacctctcagccctggcggctgcagacaagagcaagaaactggattggtgtgtctgggaggtaggacccaggctcagtgccggctctgctcaccctatggggcaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctggtgagtggggaaaggtctggcctgggaacgggggctcctctccaggcctcaaatgacacatctgtaaattgggtggcatacagctttctggaccctggtgggtggagttggcccctggttggtcgcatgcccaagggggcagcaggcccagtgagggctcagctgtttgcccctcccctaagcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggtgagccaggccagggttgggacaaggcagggagccttagcttctgctgaaggccgaccctggccttgaccctggccaagagggacggggggtgctgggcagaaagaacagctgtgcaaaggccctgaggtgtgggtagcaagtaaagactggcctgagtggcttcacagagtcaagccgtgctctgtgactctgcccccaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaaggtgagggctgggcatgctgttaggggccatgtggcccagtaccttcctctaagatggctcagtccccaactccagagttttgttcagggaggccaggtgggaggtgggcaggctgcaggaggtggtccaggcacaggggcagtacaaagcccctggggctgggaagcctgtgctgttcagagtggcgtctccggggtggccggaagaccaggatgaaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgccagcccgttaaaattgggggtgggcagagtggggttcccagggaactctggtgcaggggcagtgggcccaaggcaggtaggcagaacaggtgggcaggcagggagctggggttaaagggggtggatcaacgatactgtgcgggacctaaggcagaccgcagggtgaggtctaaggtggccaaagcctgggtcagcaaaggagagttctggaacgcggggcagaattcagccgggcaaggataagggtacaggctgggcatgggagctagaccagtgggctgacacaggggagctgagagtagggtggaaggggtgttgccaagagcagtgagaaggcagggccaaaacctgttattaggaggcaaggacacacctggatgccaaggaggtggggccaagggcgggaccagagtccagtcttgaataaattactgagcagtgttagccgccagctggttacacctagacatatgttcgcatgtacacacacgtggagtttatgcacacaccccacccgccccgagttttttttacccacattcacccaggtttccactcttccatgaacccacttgcttgtgtaccctgatatgcgtgcatctaaacatgctgctggcatctttacaaacgtgggtgaacgtgtccatatttttcatacatcccaacaccccgacgtgtgtatgtttatagacacagatgtgtatgttttattttagacagactctcgctttgttgcccaggctggagtgcagtggcacaatcttggctcactgcaacctccgcccccagggttcaagcgattctcctgcctcagcctcccaagtagctgggattacaggcatgtgctaccacgcctagctaatttttgtatttttttagtagtgatggggttttgccatgttggccaggctggtctcgaactcctgaccttaggtgatccacccgccttggcctcccaaagtactaagattacaggcatgagccaccgtgcccagccagatctgttttttttgttgttgtttgtttgtttgtttgtttgttttaagacagagttttgctgttgttgcccaggctggagtacaatggcacaatctcagctcactgcaacctccgcctcccaggttcaaacaattctcctgcctcagcctcccgagtagctgggattacaggcatgcaccaccacgcctggctaatttatgtatttttagtagagacagggtttctccatgttggtcaggctggtctccaactcctgacctcaggtgatccacccacctcagactcctgaagtgctgggattacaggcatcatagatttgtagcactcaattcacctgtatgcaactctgtacccccacctgaggggcagtggttggtgggggagggggcagctcagtgatgaagaaccacaccctcacacacacaggtgtttgacaacgacatctcctacattgagggtggaacagccagtggcttctacactgtggaagacacacactatgtcaccaggtgagggtgtgtgggcagtggggggtatggacctggagtctgctggcaaggggtggaggggagggtgttggggctaagttaggcccttggtgcctacactgagccactcttgccctgcgcccaggatgtatcgtgtgtatgggaaaaagaacatcaagttggagcctgtgcccctcaaggggacctctctggacccaaggtgagccccaacaatgtgaggtgggggtgcttcatcctcagcctcctccccaccagtgggggcaggtgtgggcctcttagaagaggaggccctctagcaattcctgcccacgagcttggcggggggtccctggggcttacccagaaaccccatagtgagggattttttttggtggggtcaggagcatggggtgaccattgccccatgcaccatcacagctccttcctgccccttcttgtccaggtttgttttcctgctggaccgagggctagacatctacgtatggcggggggcccaggccacactgagcagcaccaccaaggccaggtacaaggacaccgtggggtcttttgtgtgaaggaaaggggtgtgagcctcgctgatgactttgcatcctgctctcaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgagccctgctgctgaggcccaccttggcctcccaagttcacccaccgactgggggaatggactacacaccgatgtagttggctttgggctccatctcgactttggtggggagagggtgccaccttctggacaaggaacagtatgagcaaaggtctggaggctgcttttgagaagtagcctcacggagtctttccaggatggtggggccgtaggggagacagaagcacctagtgccagggctgggaaccttggctcaattatctagattcttgtgaacaggaaagggacacgttaattagaaatggcatgaagggcctggagagggcaggcagggaaaactccatttaaaagcccttctgaaaggatatccctaaaaagaccttgaaggggagggggaaacagaagcagtcagtgagccacgctgcagggcagggctggttccagagcagagggctgtgtgggtgaggttcctgtctccagatcccttccctgccatgctcatccttcctgccaggtgggcctgggcttgggctacctggagctgccacagatcaactacaagctctccgtggaacataagcagcgtcccaaggtggagctgatgccaagaatgcggctggtaagagatgcaggaggagggcgtggggccagatccctccccgttggctgggctttgacctccagactcccggtccgcagctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgcgcttgcagcttcggaggcccctccccaggatccttcgcaccctgacatgccctgacccctgtggcttcactacctccctacagagctgggcccaaacccacctcctctttgctgactctgcccaggccccgccccctctgcaagctgcccctcctattcctacctccgtgtccgaggccccgcctcccaagccccgccctagatctcccttgggtcccgcctcaagcctcgggctacttcctccaactctaatcatgccgcacccctcatggttagttgatggcctccctggcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggtgggggcagggccgggaccggggcgcgggggggggggtggggggcaggccgagggcggggcctatgcgcagagcgcgctcagacctgccgcggggcgggtccctctcacctgcaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtaccacctcagcactcccttccccaagtccctcccctggtgctgggggctcgagcccctgctcacaaccttccaacccggcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtgtgcctggcagccccgcgagcccgaggccaggcggaggggtgtggtggggctcagacccagcgaaggttaggctcccgaggggcaggtgggggtccagggagctgcccctaacacttccacatccccaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcctggctgggggaggacgcagtggcgagcaagcgtcagggagccaggcctgaatccttgctgatgccccatcccttccacaggtgcatccagatcaacaccgactccagcctcctcaactccgagttctgcttcatcctcaaggtggggttgtgggtgtgagccaggactccgtggaccaaggggtggggtgtttgggggctgagtcagctgcgaacacccccacccctgcacactccccaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaatcagtatttttaatattaaaatggcgctaatttt

SEQ ID NO: 953 - DNA, 1472 bp, Homo sapiens
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctt

SEQ ID NO: 954 - DNA, 2446 bp, Homo sapiens
ctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccaaaaaaa

SEQ ID NO: 955 - DNA, 1266 bp, Homo sapiens
cagtttcatttcactcattaagctcagcacactgctgcccattcccagggtggacagcccatgcagaggctttgctaggtgaaaaagcttggtttgctaaaagtcacaggcagaatcctgcaggtccatgcccttagatgtgccaaattgtaagttgcatagattttaggggtttggggcaaaaaggaaacttatgtttaagtgctctagggaaggaggcattgtttccaggtggtttcattgtcatatgatctccaggttcagaaggcaggtagtgtctggagaaacgattcctggccctgagaagttgaccattaatttctgacagatagtttaagtgcctcctgtgacatacaaaagagacacacactgtccttgtgaaattcatgagctgcaggaggagacactaatcagatcatcccagaaacgtggaaggagggccagggatggagccaaggagctaaggagggctttcctgaggaggtggcattggacccgaggcctgagttgtgattaggattacagaaaggggatcaggcaggggagcctctggaaagaaggacccaaatgtgggaagagagtatggcctgatgaactagaagcgggcagaagagaacgaggggaaagagggtggtataaaattaggtccttgggaacacagtagggttgttggtgtttatctcaaggaaaatggaaacaacagtgaaggactcttggcaaggaagggacttggtcccacatgcctgagcgtagctttcgctgttctgtggagaaagtcaggaaaggggatttgcgaggtgtttagctttccacagggcaggggtatggacagcagaggatggcactgctcaccgcttccccaactcctgcaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcatacccagcagtccagtgcaacgtctcctccatagctctgggttcttagatcttggttggacgtttgttttctccttagttgcatttcctgggtttttgtgatgatcaatggactttaatgaaaaaaaaaataaaaacaacc

SEQ ID NO: 956 - DNA, 1271 bp, Homo sapiens
ggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggcccggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttgacaaaaaaaaaaaaaaaaaaaaaaaaaaa

SEQ ID NO: 957 - DNA, 693 bp, Homo sapiens
tccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgaccaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaaagatttaatcaattaaaatatatataaaaaaaaaaaaaaaaa

SEQ ID NO: 958 - DNA, 853 bp, Homo sapiens
gacagggagtcagactggtcatgcaaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctcc

SEQ ID NO: 959 - DNA, 4002 bp, Homo sapiens
ccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaa

SEQ ID NO: 960 - DNA, 2855 bp, Homo sapiens
cgcccgggcaggtcggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaaaaaaaaaaaaaaaaaaa

SEQ ID NO: 961 - DNA, 421 bp, Homo sapiens
gggccgcgacctcccgcctccccgtctgccgctgagggcccgcgggtacacaataggcttcccagaaggttaagaggcagaggtagaagaaatacggactttaatgaagagttttccctttggtataagtgagacccgtggaaacatccaaacagcaaaaggaggccaggatgaaaacggtcaactctcccttatccacaaggccaaaagagggggggccggcttgctgtggtgtggccaccccgggcctaggctgggcggggcctgtagaaggtactcaggaactgcaggttttgcgtttcccctccatgaaactgacaggcattcgggctgacttctgcctctcagtctcgcggtaagagacccaagtttttctagtcctagatggaaataaatttcatctgcctcaaaaacctcgtgc

SEQ ID NO: 962 - DNA, 742 bp, Homo sapiens
cccttccagcacgggccggccaagttgctgcggcggaggcagcatttcagctgtgaggaaggtcattggattcatgtgttttatctgtaaaaatggttgtcttaacttcttaacctcatatggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccatgtattcagttcattaccaaagaaatgttgcctttgtaatgatgcctttccagttcaaataaatgggtccatttcaaaaaaaaaaaa

SEQ ID NO: 963 - DNA, 1444 bp, Homo sapiens
acaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttgcacccaagtccgcatctgtgtgtatcatcaataaagttgtgtgctttgattggcgaaaaaaaaaaaaaaaaaaaaa

SEQ ID NO: 964 - DNA, 1856 bp, Homo sapiens
ctgacttggcaggactgtgcaattgtcagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactcta

SEQ ID NO: 965 - DNA, 546 bp, Homo sapiens
ttccagacaatatttttctgctgtttaattgatctcaaggaaggagaaattcaagtccacaaaaacttacatcaattctgtttatcacatacaaaactaaacatacaatataacagcaaataacaaacatgctgaatattttcaagccattttgaatggtgtcctgtacatgtacataaataatacatactgcttctgaattaccttaaaatacagtaccaccaagagttatatttctatgtaactactccataagtgagcataaaggaatgaggaagtagacgatatccatatcagataaagtagaaagtcttatgtccttctgaaaagcaacacagtaggcccaagaacaactacaaaccattttccttttagctaggaggtatatggcaagaccaatgatattctcttccccatcctttttgtcacagggtatgaagtctatcctattcaagttagttacaagtcttcagcccatttagtcatctaagaagttgagaaagtctaaacctaagtaatcacagcaaatactgcaaatactgatat

SEQ ID NO: 966 - DNA, 6919 bp, Homo sapiens
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagcgttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttctctttccattcaaatagtcctggttcattcccagaagggcacaaaatgaatgaataaataaataaatgaataaagacaaaagccaaggtgtatgctctcaagttccaaagatgttatcaaamgctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcgctctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtggagatgggttttcaccatgttggccaggctggtctcraactcctgatttcaggcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttgggcgacggagtgagaccctgtctcaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatcgtctcctatggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcataacaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttg

SEQ ID NO: 967 - DNA, 3095 bp, Homo sapiens
gggtcgacccacgcgtccggagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaaaccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaaa

SEQ ID NO: 968 - DNA, 1114 bp, Homo sapiens
gcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaaaaaaaaaaaaaaa

SEQ ID NO: 969 - DNA, 1110 bp, Homo sapiens
cctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaaaaaaaaaaaaaa

SEQ ID NO: 970 - DNA, 1360 bp, Homo sapiens
gcccttgccttgagtcagtgcgctgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcagataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttg

SEQ ID NO: 971 - DNA, 559 bp, Homo sapiens
  misc_feature 545: n = A,T,C or G
acaaagcactttataaaaaaattctctgcacacaaatcctataattttcatataattatcatactaaagataaattcactttaaagccaacacttagaacattttaaaacaaaaaggtaccagtacctaaacacagacgttaacaaatacaagaatactgtactgccaagaggtttaatcaaatgccttttgaaagtttctgcaaataggttaagaaaacatgtgtgagaatttgcccacgcccacccccatctctccaatctacccaagaggaacccagttacccgaaggcaggttccacagcccactcccagcagcagtacaatatcaaaggaaccactgaccagatgaaacgcttacatcacaagcccattttatacacgtgacacaaagacacagaccgtgagaatcccattaagtcatttagaatgtgaacaaacacacgtggcgaaaaccgatttacataaaatttaagtgtattattaaagaattaaaggctattcaggtttcttttttaaatgttacaaattttttttttgtcattntcaggcacatactg

SEQ ID NO: 972 - DNA, 212 bp, Homo sapiens
tgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatat

SEQ ID NO: 973 - DNA, 1737 bp, Homo sapiens
gcggacgcgtggggggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggttttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaaaaaaaaa

SEQ ID NO: 974 - DNA, 508 bp, Homo sapiens
tttcctgaccgtactcctcaaaatccagattgtttgtgcatacatttaaaaaaaaaaaaatcaatggaaatttccacctttgttcgaacacataaagtatgccatgagcaatataacatcacaaacgtactgtgacaaaccattaataaagaaggattactaagccaggtgtggtggtgcatgcctgtagcccagctatgcaggaggctgaggcaggaggatcacttgagcccgggagtttgagtccaccctgggtaacacaccaagactccatctctaaaaaattaaattaaaggattactgaaagatctcatttctaaaaaaagaaaaagaaaaagatcactgaagtcagacatgatattttaattttgtattttgaaaagtcagtatataaataagaaaaaattattttagaaattatgtgaaaatccactcttgggtggagtaaatgcaatggtttgccagcactggctctgagccaactgtgcacatcctttctgaactctaa

SEQ ID NO: 975 - DNA, 272 bp, Homo sapiens
tccaggaaatgcgcgatccaggccggcgggcggggcgggggctccggcgagagggcgggccccgggaacggcggcgggcggggcgggaggcggggcccggcccgttaagaagagcgtggccggccgcggccaccgctggccccagggaaagccgagcggccaccgagccggcagagacccaccgagcggcggcggagggagcgacgccggggcgcacgagggcaccatggcccagacgcccgccttcgacaagcccaaagtgagcgcgcgcg

SEQ ID NO: 976 - DNA, 2444 bp, Homo sapiens
agatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccaaacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgacaatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcacccgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttaaaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaacc

SEQ ID NO: 977 - DNA, 3889 bp, Homo sapiens
gagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcaccagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgtttttttttttttttttgtactgtgtcctcaaatttaatggattaatgtgtcttgtatatataaaaagaaaacctctaccttcaaaaaaaaaaaaaaaaaa

SEQ ID NO: 978 - DNA, 1566 bp, Homo sapiens
ggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcaaaaaaaaaaaaaaaaaaaaaaaaaaaaaaaaaaa

SEQ ID NO: 979 - DNA, 811 bp, Homo sapiens
gttttctccaaaaagggcatttcaacaatgggaattatttaatgtaacartgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcggggggaaaatatatttttacccaaacatta

SEQ ID NO: 980 - DNA, 772 bp, Homo sapiens
ggagaaactatggaggagtatatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccaggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaactatctctttccatttcttactatttggttttcaaatttcatttaaatgtcagaatttccttttttaggaacatgtgtatttcattgcactatttaaaataaactcaatttgcatgccatatgcacatttgattactttttatttcttcggaa

SEQ ID NO: 981 - DNA, 403 bp, Homo sapiens
gccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggacg

SEQ ID NO: 982 - DNA, 717 bp, Homo sapiens
agagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttctgccgggtgttgtatgtgtggtgacttgcggatttatgtttcagtgtactggaaactttccattttattcaagaaatctgttcatgttaaaagccttgattaaagaggaagtttttataat

SEQ ID NO: 983 - DNA, 2000 bp, Homo sapiens
cttggcacgagggattggtctgtgctcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttatcctgaaccttggcagacacgtcttgttttcatttgattttgttaagagtgcagtattgcagagtctagaggaatttttgtttccttgattaacatgattttcctggttgttaatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaccaaaaaaaaaaaaaaaa

SEQ ID NO: 984 - DNA, 2794 bp, Homo sapiens
gagagaagaggaggtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctaaaaaaaaaaaaaaaaaaaaaaaaaaaaaaaaaaaaaaaaaaaaaaaaaaaaaaaaaaaaaaaaa

SEQ ID NO: 985 - DNA, 584 bp, Homo sapiens
gggggggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaac

SEQ ID NO: 986 - DNA, 551 bp, Homo sapiens
tttttttttttttttttccatgtgtaaaaatacagcttttattctgagacattgaccttcactagagtgggacctgtggccccagcctggctggagaagcagtcccagggcctgagtgacaccatttccctttcctgaaataggaacaagttattccaaaggagaaaggagagcccagagagatctgtacaggacctctcttgcacatggtgactggaggcagagggtggggagctggagaggagtccagtccctccaacaaatattgagggcttcaaagagctcttcctggacgtttctcttaatctggatttaaaagggacaggaggtatcttagggtccaagaacataacaggaatgggcaactctagaagtgtttgtgtgtggaaggccctaacctggccctgtcctccctgtctctacctttggctttcatgaagagagattcacagctcagaggaagggaggaatttctccagtcttcactttaacaaactcttttaagttttctgcctaccttatgttccctttggccaatgacccactccctg

SEQ ID NO: 987 - DNA, 840 bp, Homo sapiens
atttagattgagttcatttatttgaaacagactgggccaatgtccacaaagaattcctggtcagcaccaccgatgtccaaaggtgcaatatcaaggaagggcaggcgtgatggcttatttgttttgtattcaatgattgtctttccccattcatttgtctttttagagcagccatctacaagaacagtgtaagtgaacctgctgttgccctcagcaacaagttcaacatcattagagccctgtagaatgacagcctttttcaggttgccagtctcctcatccatgtatgcaatgctgttcttgcagtggtaggtgatgttctgagaggcatagttggccagcaggcgcatgaaggcaagttgggtagccatttccttggaagtcaccccttctacattatattcaaactggctgccagcattgatagtttctcctagccagacgtgtttcttgtccttggagctcctataccagttcttggctgggatgttttcaggttgggcccggatacaggtttcgccagtagagaaatcacagtatactttgatagcatccatagtgcatccttggttagggtcaatccagtagtaaccactgctccactctgggtggctgagtctcaagtcacggcatgtgcgagctgggttctttctagagccttcaggagtaagaaggggtctcaatctggttgttgagagacctcgagtagcatcaacttcatagtccttgggttcgagagaaggtgctgagccaggctggtcagcctgtagaagtctcatcgtaaccaagtcataaccccaccgcttacaccggaagtccggagggcaggggacagggggg

SEQ ID NO: 988 - DNA, 1035 bp, Homo sapiens
aggtgctgaaccgcgcacgcctagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaaaagaattccacttgatcaacttaattccttttctttatcttccctccctcatttcccttttctcccaccctcttttcccaagctgtttcgcttggcaatattttactgggtaatgagttgcaggataatgcagtcataacttgttttctcctaagtattggagttcaaaactcctgtattctaaagaaatacggtgggggctccttaataacagaaaatctttctatcttaaaaaacaacaccacaaaacacaaacaacaacaacaaacaaacacacacaacacacaacaaacaaaaacaaaaacagggggggggcgccaaaaaaacaacccaagggagggcccaaaaaatagcgaaccacacttttatgaacaaagggggccccaaaggggacgcgaaaaacagcaggaagacgccgggcttaacacagggaggaaaaagccacggggcaacttgagaggaacaccaccatagcaggggaggaaaatattgggcaacccccagaaatattagcctggggaaataacaccgcggggtattaggtgagaccagccatagtgtcgggccagaaatattttgctcgtctctttttaaaatcgcgcgtgcgtataggtcatcaacactaaagtcaccggccgcgggcggcggggcgccgtggtcggagtgcatctcacaaagcacgaagcgaccgcatgcggacgggcgcgcagagacacaaatcgagtagcacacagccgcaagtcata

SEQ ID NO: 989 - DNA, 1424 bp, Homo sapiens
ctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttaaaaaaaaaaaaaaa

SEQ ID NO: 990 - DNA, 1466 bp, Homo sapiens
gcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaa

SEQ ID NO: 991 - DNA, 1952 bp, Homo sapiens
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgagttggcattaaggaagccaatacct

SEQ ID NO: 992 - DNA, 1081 bp, Homo sapiens
  misc_feature 643, 1080, 1081: n = A,T,C or G
gtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatgtgtgctgggtctctagagaagtttttatttgttacaatactgctgctttgagcaattttgtttctcttcattgtctgttaggggaatcaccagctttggcatcttaacaacaaacagtggatgggtaatttttatttctgatacgcatctttagagtcaaatatatcttttccctgtactcctcatgtacaaccaaagaacatacctttttgacccttgtacttataatatctgngaacacaacattttcctctggcaggtgacctttgtgcgaaatggatcataaaaaaaacactgtatttcttcggggcggcctcgcgactaccggcataccttttagaagcctggggattaagggaacccggtgtaaatacacggttgccccctctctcacaggttgtgggtcttacagccacggattgggggctccaacgagaggggggcccctaaaggggcgtctgagaatgctggttacaattgtgtgtgcgcaaactctcactcacagtacgccgcttggtttcacctcgtgttgtgtcatgaaccacgcgtgtctgacaactgactgtgtctcccacaacacagcggcgctgtcagtacaaacgtctgatcttttggctagcatcactgtattgactgagcgtaggtcatctgcatcattatctactccactgnn

SEQ ID NO: 993 - DNA, 2270 bp, Homo sapiens
ttttttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgaga

SEQ ID NO: 994 - DNA, 561 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 995 - DNA, 258 bp, Homo sapiens
gcctactactactatacggctgcgagaagacgacagaagggcggggaacctgctggctactgattgctccaggcagacaaggctgacaagcaatccagggacaagatactcaccaggatgaggaagaggactttgggggacgggcttcccctgtgagcagcagagcagcataataaatgaggccactgtgccaggctccaggtggcctccctggcctgccaaaaaaaaaaaaaaaaaaaaaaaaaaaagtcgtatcga

SEQ ID NO: 996 - DNA, 7380 bp, Homo sapiens
cggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtctttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtaaaaaaa

SEQ ID NO: 997 - DNA, 795 bp, Homo sapiens
cttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgttacaaaaaaaaaaaaaaaaaaaaaaaaaaaaaaaaaaaaaacaaacaaaaaacaaaaacaaaaaaaaacgagagcaaagagcacccgcaggggagcgcagacagcagcaacgctgctacacaggagagcgagagatgagagacaaagtgtcgtagaggagtgttgaggcacaccagggacgcgaggcgagaggagcggcgacaagcgtgcggagaggatggcgagacagaagagcgagaagaagcggacacaaaaagagaaaaggaagagggagaggaaagaggggcggggaagagagggtaggaggggcgagaggaggagacagagagatacaagagagagagggaaagaggaaacgaaaggaggaggggaaggatgagtgggcacggcggtagacgacggagggggggaaggtggatagacaagaagaaagaggcggtaatcgagagcggggagaagaaagagggagagaaagag

SEQ ID NO: 998 - DNA, 454 bp, Homo sapiens
ctcagctcctggggctcctgctgctctggctctcaggtgccacatgtgacatccagatgacccagtctccatcctccctgtctgcatctgtaggagacagagtcaccatcacttgccaggcgactcaggacattggcaactatttaaattggtatcagcacaaaccagggaaagcccctaacctcctgatctacgatgcatccaatttggaaacaggggtcccatcaaggttcagtggacgtggatctgggacacattttactttcaccatcagcagcctgcagcctgaagatattgcaacatattactgtcaacagtatggtaatctcccattcactttcggccctgggaccaaagtgcatatcaaacgaactgtggctgcaccatctgtcttcatcttccgccatctgatgagcagttgaaatctggactgcctctgttgtgtgcctgctga

SEQ ID NO: 999 - DNA, 2381 bp, Homo sapiens
gcctggattctcccagagattgcctggaacaccagctcgggtcctcgcacaccatcctgcgggtgcagcccagaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactcaaaaaaaaaaaaaaaaaa

SEQ ID NO: 1000 - DNA, 745 bp, Homo sapiens
  misc_feature 557, 613, 615, 623, 655, 714: n = A,T,C or G
aggaacataaaatttattattatgcaactagcaagctggggtcaaagggctttcccaaaaaaagttgtgtttccctatattacaggtaccaaaacagagcaaaacatccaggagaaccaaactgaaactcagaaaagagacaatttctgaggcccaccagatcctgattccattttgaaatactctattgcagtacctctgggtaaatattagctggttgctaaagacaggatctgaggctgggccaattcttaaggcaccagctgtcttgaggaggaagatgaagactgtgaatgaaggacagcagacttgcttctaggaaaataatatatgtaagttgggatgcctcttgcagccagatgtttccgaataagtcgctcagtaccataccagttaaaacctttcgtggcatgtccaatacgtggaagatgaacacttgctttcttcttttttgctgctaaaaatatcttcttcaggccctcttctagggctgccatcttaatgccagacaggacattggaacgatcacgatgctgagccacaatcaagggcaacanatcttgccctttgtttcttgattctttatcatcaaacaggaaataaaggacacctncnaaactcangtctttcatttcccagccagctcatatatttntcttggctcagcggatcgcttttccagagctgtaaataaaccacctctgccccagtggncacagtcatctacgcagtgcacaatgagagc

SEQ ID NO: 1001 - DNA, 2413 bp, Homo sapiens
ggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaaaaaaaaaaaaaaaaaaaaaaaaaaaaaaaaaaaaaaaaaaaaaaaaaaaaaaaaaaaaaaaaaaaaaaaaaaa

SEQ ID NO: 1002 - DNA, 581 bp, Homo sapiens
  misc_feature 460, 539, 549, 553, 566: n = A,T,C or G
aagaaattagacttttatcaatacacaaataattttacttaaaatcaacccagttacatatttttaaaaaattgcagaacctctccacaccaatgtccacagcctagaacaggttcatgtgaaacctgcagtcctaccccggagcatcagttaagtgatggtccaggtactcactgacacgtttctcttgacactgagatggtcgcaaacaaaacaccgttcttgcctggatgaagcaagagttcacataaaagagctttataaaatgtctatgaaggagaattgataatatcagaagagctccagcacttcaattgaatataatcctctattattcttttcttgatttaatttctgtagctcccgaaaacttacttcaatcttgttgagctcagaataaacagatatctgagattttacaagcttgttaagatttatcagtagcctctttgcttccggnatcattacacaacagttaaattcgctccagaagttgactttcccatccataatctggtccagggagggggtgtttcccngaaaatcttnttcntttcgcacctccnggtcggaaatcaatc

SEQ ID NO: 1003 - DNA, 2043 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcct

SEQ ID NO: 1004 - DNA, 1734 bp, Homo sapiens
ctggtggaccagctggctcctaaagaggagaggggactaaatcatgtatgcttggttctttcttcccagcttctctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgaaaaaaaaa

SEQ ID NO: 1005 - DNA, 2498 bp, Homo sapiens
gagctcctcctaggacacccctttccccttggggaaaggattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcaaaaaaaaaaaaaaa

SEQ ID NO: 1006 - DNA, 502 bp, Homo sapiens
caattcttaatcatttattttcaacacgtgtactataaagaacctaagaaatcagacaattttaataacccataaacatgttgaatccatttgcagatttaaattttgtaaaaatagctgtcactgcctccatatatcaagtgtactatgtttataatcacatttatgctaccgatactcctcagaaaaaaacagattctgcttggttctagcttcagtatcatgaactccaataatgccttgaggacctccaaaggaaaaaaacagattctactaggttctagctgaaatattatcaactccaaattgaagctgaagtattatcaactccaaataatgcttcgaggacctccaaaaaaaagagattctgcttggttgtagctgaagtattatcaactccaaataatgcttggaggacagcaatgtagatgattttgtaatcacctttcatcggagtgaccttatataaaaaataagtcaataatttagaggttctaagtct

SEQ ID NO: 1007 - DNA, 975 bp, Homo sapiens
gcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaa

SEQ ID NO: 1008 - DNA, 8054 bp, Homo sapiens
atgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaaaatggctcttggagcattgctactcagttcaccatagtcttggtagagccagtggagttgtgctcacctcccttcagtggactctaatgacttatgtttgtgatattcttaagccatttgaggaggctacccagaaagtgagcgtgaagaccgcaggattgaatcaggtgctacccctaatccatcatctactcctttccctgcagaaactcagagaagattttcaagtcagaggtattactcaggccctcaatctggtggatagtttatctctgaaacttgaaacagataccctactaagtgccatgcttaaatccaagccctgtatcttggctactttgttagatccttgctttaaaaacagtttggaagacttttttcctcaaggtgctgatttagaaacttataagcagttccttgcagaagaggtctgtaattatatggaatcttcaccagagatctgccaaattccaacttcagaagcttcttgtccctcagttacagtgggagctgattcatttacctcatctctaaaagaaggcacctccagttccggttctgttgatagctcagctgtagacaatgttgcccttggaagcaaaagcttcatgttcccttctgctgtagcagttgtggatgagtacttcaaagagaagtattcagggttctcaggaggtgatgaccctttaatttactggcagaggaagataagcatatggccggctttgacccaggttgccatccagtatctaagttgccccatgtgtagttggcaatctgaatgtatctttactaaaaatagccactttcatccaaaacagatcatgagcctggactttgacaatatagaacaactgatgtttctgaaaatgaacttgaaaaatgttaactacgattattctacgttggttctgagctgggatcctgagcagaatgaagttgttcaaagcagtgaaaaagaaatactgccttaatttctttttctccatttaaaatgggcaactttttgctgtgttactgtatcttaatagctgtagttgttaaatataatcattatctttataaacacatctggggaaacctgaaatcacacaagggctgaaaattcctcagaggcaatataattttgataaaatgaagattaaagatttcatagctataactgtggcgctagcacttgaaaattttgcttataccaatgagagaggagatatttttaattaaaaaaaatatagtgcagcattgaaaggccttaggctttcttcctggtagattgaactagtaattggttttaagtaaaacttcccccaccatgggaaattttattgctctgaaatcaacgaaatgagaaaaaagtacactggctggcattcctcctgcccctgtttttctgtttccttaaaaaccctgatgcttaattacaacttggcaaaaagaaaacccgtgaaattgttttatatttggaaatttctaattgcctcctcatactggtcagctttataatttcaaattgttgagtgtgatagtgttaccctttagaattggatcttatataaaagggaaatattagaaaacaattaggaaaatatacttttagtctttgaaatgcctgttttaacctttataaaatattataaaaatagattgtgtaggtactttcaaataatttatgggtaaaaacagactaaaatgtttgcaagaattggaaaaggttgaatgggaattgtaatgagagccctttgaacatgcttggaaaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttaaattcttaaatggtaaatatgccattgtgaaatgaaatctcaactccaaaagtttacccttttactaactggagtaaatgtatacttacaaagtctttagccgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagttagtatatatctgtatgtatattatatacataaaacgctatatttttacatacaagtatgcttttattatacagataataaagatgggggaaggtttctgtttttttcttaataggtgaagaaatcttgaagaccagaaattggatcttactgaaaaactgatgtttttttgttttttttttaaattatattgttcagctatggaagatggatttttttttcatgatcctttaactctcaagttcatctttaaatgaactcttttttttttgttttttttttgttttgttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaatttttttctgcctcattattattaattcatgggttgagtgttggttcgacctacaggcgtaatagattggaactcagtgaagacacagatgttcctgttcagagcaaccagctaatgattacagtttaaagacaatttctgtgatcaagttgtcatttggaagattaaacccatttcacgaggacttggagcctggtccttgctttgaggaagccgtggcttgtttcaagaagccacttctgatctaagaatctacccagcatgcctaatcaaggggaagactgctatttttttttctattccacatgtaccaaaggcgacagctgcccattccgtcactgtgaagctgcaataggaaatgaaactgtttgcacattatggcaagaagggcgctgttttcgacaggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaactgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgaattttggaataaaaacccttgaggaaattaagtcaaagaaaatgaaggaaaaatctaagaagcaaggtgagggttcttcaggagtttccagtcttttactccaccttgagcccgttccaggtcctgaaaaagaaaatgtcaggactgtggtgaggacagtaactctctccaccaaacaaggagaagaacccttggttggattgagtcttactgagagactggggaaacgaaaattttcagcaggcggtgacagtgatcctccattaaagcgtagcctggcacagaggctagggaagaaagttgaagctccagaaactaacattgacaaaacaccaaagaaagctcaagtttccaagtctcttaaggagcgattaggcatgtcagctgatccagataatgaggatgcaacagataaagttaataaagttggtgagatccatgtgaagacattagaagaaattcttcttgaaagagccagtcagaaacgtggagaattgcaaactaaactcaagacagaaggaccttcaaaaactgatgattctacttcaggagcaagaagctcctccactatccgtatcaaaaccttctctgaggtcctggctgaaaaaaaacatcggcagcaggaagcagagagacaaaaaagcaaaaaggatacaacttgcatcaagctaaagattgatagtgaaattaaaaaaacagtagttttgccacccattgttgccagcagaggacaatcagaggagcctgcaggtaaaacaaagtctatgcaggaggtgcacatcaagacgctggaagaaattaaactggagaaggcactgagggtgcagcagagctctgagagcagcaccagctccccgtctcaacacgaggccactccaggggcaaggcggctgctgcgaatcaccaaaagaacagggatgaaagaagagaagaaccttcaggaaggaaatgaagttgattctcagagcagtattagaacagaagctaaagaggcttcaggtgagaccacaggagttgacatcactaaaattcaagtcaagagatgtgagaccatgagagagaagcacatgcagaaacagcaggagagggaaaaatcagtcttgacacctcttcggggagatgtagcctcttgcaatacccaagtggcagagaaaccagtgctcactgctgtgccaggaatcacacggcacctgaccaagcggcttcccacaaagtcatcccagaaggtggaggtagaaacctcagggattggagactcattattgaatgtgaaatgtgcagcacagaccttggaaaaaaggggtaaagctaaacccaaagtgaacgtgaagccatctgtggttaaagttgtgtcatcccccaaattggccccaaaacgtaaggcagtggagatgcacgctgctgtcattgccgctgtgaagccactcagctccagcagtgtcctacaggaacccccagccaaaaaggcagctgtggctgttgtcccgcttgtctctgaggacaaatcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacattttaaaaaaaaaatcgccaaaaaactggacttagtttcatctattgtaacattcacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagccttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttatgtatagacacacctctaccaatccatcttcagctgactgaatgttgtatgatagcccttctccaaagcagaggtagaatgttcaggtttcaccatggattttctacttatttcgtttttggaatcaccttacagattccaggtcccttttgtatatattctttattcttttgctttttaaaaaataattttgtttcatatttaaagcacttgtattagtcaatgtttcgtgttccgcattatttgaaccatttgcccttacagaaagagaaatacttgttagtgttttaaataaaactgatgtaggaaaaaaaaaaaaaaaaaaaaaaaaaaaaaaaaaaaaaaaaaaaaaaaaaaaaaaaaaagaaaaaaaaaaaaaaaaaa

SEQ ID NO: 1009 - DNA, 2744 bp, Homo sapiens
ctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggacatcaaccaggaagtttataatttcctggcaactgcaggtgccaaatatggcgtgggcttctggaagcctggatctggaatcattcaccagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggcatggcgacaatctgcaacatgggtgcagaaattggggccaccacttccgtgttcccttacaaccacaggatgaagaagtacctgagcaagaccggccgggaagacattgccaatctagctgatgaattcaaggatcacttggtgcctgaccctggctgccattatgaccaactaattgaaattaacctcagtgagctgaagccacacatcaatgggcccttcacccctgacctggctcaccctgtggcagaagtgggcaaggtggcagagaaggaaggatggcctctggacatccgagtgggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgcacagatcttgagggatctgggtggcattgtcctggccaatgcttgtggcccctgcattggccagtgggacaggaaggacatcaagaagggggagaagaacacaatcgtcacctcctacaacaggaacttcacgggccgcaacgacgcaaaccccgagacccatgcctttgtcacgtccccagagattgtcacagccctggccattgcgggaaccctcaagttcaacccagagaccgactacctgacgggcacggatggcaagaagttcaggctggaggctccggatgcagatgagcttcccaaaggggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaagaaacatggcatcaggtgggtggtgatcggagacgagaactacggcgagggctcgagccgggagcatgcagctctggagcctcgccaccttgggggccgggccatcatcaccaagagctttgccaggatccacgagaccaacctgaagaaacagggcctgctgcctctgaccttcgctgacccggctgactacaacaagattcaccctgtggacaagctgaccattcagggcctgaaggacttcacccctggcaagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgaaaa

SEQ ID NO: 1010 - DNA, 1032 bp, Homo sapiens
agggagtcagactggtcatgcaaggtcctgggcctgccttgggtcctggggagccacggaaggttgtgggtgccagagggttgcggtcagagtcacagtcaagggccttctgagacctgtgccccctccccaccctccctccccacctcctcaggccagctctggggtctcggcaggtggtccgcaacatgacctccgagttcttcgctgcccagctccgggcccagatctctgacgacaccactcacccgatctcctactacaagcccgacttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactc

SEQ ID NO: 1011 - DNA, 3638 bp, Homo sapiens
agtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtcaaaaaaaaaaaaaa

SEQ ID NO: 1012 - DNA, 1630 bp, Homo sapiens
agggccggggtggggcgctggcgtttccgttgcttggatcagtctaggtgcagctgcggatccttcagcgtctgcatctcggcgtcgccccgcgtaccgtcgcccggctctccgccgctctcccgggggttcggggcacttgggtcccacagtctggtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaattagaagcttagccttgaaattgtgaactcttggaaatgttattagtgaagttcgcaactaaactaaacctgtaaaattatgatgattgtattcaaaagattaatgaaaaataaacatttctgtccccctgaattat

SEQ ID NO: 1013 - DNA, 2311 bp, Homo sapiens
cggtactctgagtgcagtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgtag

SEQ ID NO: 1014 - DNA, 1696 bp, Homo sapiens
aaatagtaaagctaaaacattttgagaaatttcaggatacagcagaagcattagcagcattcacagctctgatggagggtaaaatcaataagcagctgaaaaaagttctgaagaaaatagtaaaagaagcccatgaaccactggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataattaccatactgcaagtgtttacagaaagttggcgataggaagactatgcctctgccagctttctgagttgctgccagaagaagttgaagcagaagttgaaggcagctgcagagatatccatgggaacagaggtttcagaagaagatatttgcaatattctgcatctttgcacccagtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcggcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttacaa

SEQ ID NO: 1015 - DNA, 367 bp, Homo sapiens
  misc_feature 51, 284, 290, 297, 313, 319, 333, 355, 361: n = A,T,C or G
ttttttttttttttttttttttttttttttaaaatgtaagaggtttattcnccttttatcaagcagtgtctacagacagagcatccacatggtgtaagctacaaaagaaggatgtatgcgacagacttacatgaaatcattaagtcacagacactttatatggttcatgttcacaaggaagaaaattgctaaaaagtaaagcagattcaataagtagaaacataagctgatttttgttgtttattaaatctacctcgcatgtttctgctaagaagaaatctacngtatcncacagcncaggatgctatatacncataanggtattacacactntaaaatttcaggtttctaagcngttttntacaat

SEQ ID NO: 1016 - DNA, 526 bp, Homo sapiens
tttaattactttaatttttaataatggaaacaattttgccattctagaaactattttaggggagaaaaatcttccctacaaaaataaacttaaacccatcaaaattataaatattataactttttacttctgccatttaaaatgctctcctgcaataccaccccttcatttaacatccttcctgtaccatcacatattgaagagaaaacagtattacagcaaagcttagatagtttaacataatgatttgtacaatgattcttaaaaaatctttggccttagtggccttttttcttcacttacacattaaaaatgctgctgcagtaaccagtgtttgggaaaggacatcagtcttcaagaaccataaactgacagaatttcaatacagtaggtttccaaattgcaatttgtagtgcacatgacagtaagcgaggttttgggtaaatatagatgaggatgcctattcagacaatctacttcaagtaaaaaaaaaaaaaaaaaaaaaaaattcacagatacccatcag

SEQ ID NO: 1017 - DNA, 812 bp, Homo sapiens
tttttcattctttaaattctttatttcatgtctgtttcagcagtattgaaatataggtttctcatacgtgcaattcttttatagattcaaaagtgaggtgttgtgtgaatgttacaaatcataacatgatccaaatttataagaaagtactttaaaaatcagacaaaagacttaagaattactatgttaaatttctaatccaaatgtaaaacaagaatacaggatattggcaatgctaatattcaaaatgggtttaccccagttcataattcctctgctcccctcctacctaaaatctaagaaagtattcattataaattggaagtacagaattcttaaaaagccaactggatgctgagttgtatgattttctttacaggtacaatttacttttcagcaacctgtaagccatggaaagagtaactccatatccaacaaaaaaactcaaagctctactttggctggggaaggggtgtcaaatatgccatggtgtggtacatccgtgctccgacaaatattctgaagtgcaggatggctgtagagggtcgggaccactcaggatacaggaggcccattccaagaaatggaataatattttcaaggtcattcaagtgggctctgcgtacacgttctactctgtcatctgttcgaagatacttcttggcatcttctcctttgccaatgctacacagccttctggcattgcaaaaaacctttcttgtcaatctaatagaatgcagttgcaggactcataagcatccatttttgaaagaatcatcgttgcataggatgcaaaagccatgaaatccttc

SEQ ID NO: 1018 - DNA, 577 bp, Homo sapiens
  misc_feature 284, 444, 483, 539, 563: n = A,T,C or G
gtaatgttaattaactttattcacatttttccaagtaaatacaatattaactataagctaaaaacaatacatagttcttagaaaatacaaccccgaattattgtgtggcctgggctttgtgattatgtgcccagcctttgttcctccagaattttaaagtgaatgcagtgctcaaaacaaacttacgatagcacagggaaaccttccctaaataaagttttgttattagaagagaaatccaaaaagaggcctctactgccttcattcaagtgtcgagaatttcnaaatgggaaataatattaaaagagcaatcgatttttttccatctcacactagtaggcttgaaggaggcaaatttgggaccaaaaatctagacatagctccttgcatagggtttgatattaagcacacacttggcactggaataactccatatccaccccnatagtaccaaaattcatttcaaatggcaaacgttgtgcnatggaccagggtcatatttttaaagatcactcccttaaaatatccatttttactgngtcaccaaattatataataagggntcttatatgggggt

SEQ ID NO: 1019 - DNA, 477 bp, Homo sapiens
tttttaaggatgggacagaatttgcatgagtgaagtttattaaccagcagactatggggcatcaagcctggaaggttttgatgggtccttgttaacctcctcaggtaaatcagagagaaatgatttcgcattagcttcttgcaacagtgacttccttctcaccgtggaagagacgctgacgtgcacccctttcactttccattatctgctacagaaataacagctacgcaaatgctccaatgccatgtccagtcctaatctacccatttgtaaatgtctctgtttgccttcatgagttattatacccttttgtagccgtccgagatggtaaaaaatcagttttcttgtctcttgagagaccggagtcgtctgtgggtggagtacctactatgcatgagttatcacaaatgacacgactggggccttcctcttactcagcttatggtctaatagaggagtaaatgtaagagctaacat

SEQ ID NO: 1020 - DNA, 541 bp, Homo sapiens
gggtcaaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaaaaaaaaaa

SEQ ID NO: 1021 - DNA, 3213 bp, Homo sapiens
aatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgagagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatgagatggaagcgccccacggagatctgcgctgacccccagtttatcattggaggagccacccgcacagacatctgccaaggagccctaggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagctctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggagtcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagaggagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatcg

SEQ ID NO: 1022 - DNA, 925 bp, Homo sapiens
ggtcaccaccatccctaccattgggttcaatgtggagacagtggagtataagaacatcagctttacagtgtgggatgtgggtggccaggacaagattcgacccctctggagacactacttccagaacacccaagggttgatattgtggtcgacagcaatgatcgggagcgagtaaatgaggcccggttaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagcgcctaacaaaagcaccccaccgaccctgacatacctaccgtgtcaccctgcccagtcctacccgttcctctccatgcaagtgtggccagggcctgggtatcatgtgcacatgcccagcaagagctagctcccctgctcccctcttttcctgtcactatatgacaatcctaattgtgtctgatgatgagtcattccaattactggattaaagaaaaagtgctacggagtcaagggggggggcctcatcgcgttgaacctcgggcatcgggaagacaggggggaacatatagatggaaaggggggggcccttggaatgaaagcggacgaaacccaaggactgagccatggggtcctgtgcccacccggtaaggaaaggaggcgtggggggcaacgacgccgggaaacgatacagaaaggcggcgggcagagagaagaaaaaaagagaaaagggaagaacgggacaaagaggaacgcgctgacaagagaagagca

SEQ ID NO: 1023 - DNA, 517 bp, Homo sapiens
  misc_feature 380, 414, 448, 476, 505: n = A,T,C or G
tttttttttcagtggtaaaaatattgctttattccaaatgaacatacaacacaatttactgttcttttggggggcttcttgtgaactgaatagtctgggtatttttatttcaacaatttattcttcccatactaaccacagaagccgaagccctgggtccacacatagcagacttgctataaaataaatggtaatgaggaatgatgaggaaagcaaatgggtaactgtcaatttgttaattgtcttgtattaataatttaagtagggcatgattcaaaataaacacacatccttggatggaactcaccttatggatactggatatcattaatgaggccaataggttggatcctcttcaaaagtatttcacatcaggaaangggtcttggacagtgtccaggagttttatacggnccccaccctggcaagtggaccctggttttagggnctaaccggaaccttatacttatgggggnaattttaagtggaaaggtcctgggggggnatattttttccg

SEQ ID NO: 1024 - DNA, 549 bp, Homo sapiens
  misc_feature 483, 502, 520, 529, 535, 541: n = A,T,C or G
ataggtaaaatttttatttatgaatgtgtggacacatgactttggatccagccagccagtgacataaataaacttgagcaaaagtttcaagctagaggatatatatgtatagaaaattatatatttgtgtgtgtgtgtaaggcctcttggaacagtgccacaaacctggacaccaaccaacagaatactcccgtcctttgaaatttccattaagagcacaatgggggtaattataccaggatgctccaatcgctccttccatcttgtgcactcacatgcccgccaaacatgaaatgttcgccttctcccttccaatgtgatggttgttgaacttatctttagtgtcatttgataagcctttgtgctcacagagagacatcccactgacccagccactggtcattgtctataccagttcacatcaaagcaggcgcactttgtcaggtttccactcgaatatcatttcgcatctgaagtacagtntcgaaaggggctagaacanttgagcctttttctttanctggtggcnttcttncccaangggggttt

SEQ ID NO: 1025 - DNA, 1990 bp, Homo sapiens
gcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaaaaaaaaaaaaaaaaaa

SEQ ID NO: 1026 - DNA, 788 bp, Homo sapiens
ttcagaaacaaccctggagtaattatatactttattacaaatggtaaactcagaagtgctccaaatctcttatttacataacaacactgggcaggatacccaaacaaacaaacaagaaataacttacaaaggcatgaagctgtttattgacagtaatcagctttcatcaaattaaaaaatatatatatgtacatacacagttaacgaaggcaggccagaaagagttcatctgtaggctcagcctcgctctcacaaacctccctcctgccgccctcgtctcgaaagagtgtccagacagcctggtgcttcaaaacgtactcgggaggagagtcccatgactggccccaggacggcctagattggaacagacgagacgtgtaacagaccatgcaggataacatccaacgacaaacgcggcgcgcgagagagaacagtctgggcgatgctgtgtcatggacatgcaagcaaacgaatacttttcacacgagcatcggcgcaggagccggacgactcagtgggcaagaagttcacccggaagacgaaaacatatattgacaaaagcacgtttatacattgcgttcattaaggcacttctcacacggaacgagataaaaggcaccccaagaaaggcgatgacggaagaagcacaactcgcacacgtagaaccggcaagtgaacagttgcagccatcaagcattatcgcatcgacacacgggattgtttgaaacatttggagcagaagacagcaaaggcagtcggcattgccggggcggcaaacactaccccct

SEQ ID NO: 1027 - DNA, 1896 bp, Homo sapiens
cccacgcgtccgcggacgcgtgggcgcgcgggagctgggaggctgcgagatccctaccgcagtagccgcctctgccgccgcggacttcccgaacctcttcagccgcccggagccgctcccggagcccggccgtagaggctgcaatcgcagcgggagcccgcagcccgcgccccgagcccgccgccgcccttcgagggcgcccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaagggaccacagtgacttatttgtagttgttagttgcccctgctaccctagtttgttaggtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaaaaaaaaaaaaaa

SEQ ID NO: 1028 - DNA, 1340 bp, Homo sapiens
ccgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtggttccagccaaagcatgccgttgtgcaccctacccagttgcctccagggcctctccttggaaggtcttttgagggctaaaaaggtcctgtaagaagcggcatagcacccgtggtggcaatggttatgtgggtgaccctggactcgccactggtacccgcccttccgagcggcggcctaagcctttgccgtgagatgcacactgagaatgctaatggttgggttgattgtatgttgaggatctattactgaccgtatgatgaggccaactttttttccttgtggttagcaagactgca

SEQ ID NO: 1029 - DNA, 565 bp, Homo sapiens
tttttttttttcacatcatataatatttattaataagtaaaatgattttcccctgcctttggttattaaaaaatgagtatcattgatgataccaattgccaacactggttttacattattcagtcatgaaacagaatagaaagatgatcgatagatatctatagacataaatgtgtagaagaccataccatacagcgatttgtttaattacaaaatactggttgtgctagcagttggaaatgtacttgcacatccttaaagttatctttttttatataagtaaagaacacacaaataaattcacttgaatttgataatttggaacattggcaatgaatacagtgcctgttgaggcctgaaagagagaggaaatcaagaacagtgtgggagaagaaaggcaatccttcgttgaaaagcttttctcttaacaatccttagtgcctgaaaaataagccattttgataacaagagtataaaaagccttatgatctgcaaagtaaatcgtatctggtttaaatttcatcccaagtctcaggttatggctgaggagctatactaagtatct

SEQ ID NO: 1030 - DNA, 3818 bp, Homo sapiens
ttggacactactctaggaccgggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtttttgtctttgataaaaaactgattgacaagtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtttttgccagtttagccaatgttcttggtaactgggaaaatctaccttcccctatatctccagacattaaggattataaactttatgatgtagaaaccaaatatggtttgcttcaggtttctgaaggattgtcattcttgcatagcagtgtgaaaatggtgcatggaaatatcactcctgaaaatataattttgaataaaagtggagcctggaaaataatgggttttgatttttgtgtatcatcaaccaatccttctgaacaagagcctaaatttccttgtaaagaatgggacccaaatttaccttcattgtgtcttccaaatcctgaatatttggctcctgaatacatactttctgtgagctgtgaaacagccagtgatatgtattctttaggaactgttatgtatgctgtatttaataaagggaaacctatatttgaagtcaacaagcaagatatttacaagagtttcagtaggcagttggatcagttgagtcgtttaggatctagttcacttacaaatatacctgaggaagttcgtgaacatgtaaagctactgttaaatgtaactccgactgtaagaccagatgcagatcaaatgacaaagattcccttctttgatgatgttggtgcagtaacactgcaatattttgataccttattccaaagagataatcttcagaaatcacagtttttcaaaggactgccaaaggttctaccaaaactgcccaagcgtgtcattgtgcagagaattttgccttgtttgacttcagaatttgtaaaccctgacatggtaccttttgttttgcccaatgttctacttattgctgaggaatgcaccaaagaagaatatgtcaaattaattcttcctgaacttggccctgtgtttaagcagcaggagccaatccagattttgttaattttcctacaaaaaatggatttgctactaaccaaaacccctcctgatgagataaagaacagtgttctacccatggtttacagagcactagaagctccttccattcagatccaggagctctgtctaaacatcattccaacctttgcaaatcttatagactacccatccatgaaaaacgctttgataccaagaattaaaaatgcttgtctacaaacatcttcccttgcggttcgtgtaaattcattagtgtgcttaggaaagattttggaatacttggataagtggtttgtacttgatgatatcctacccttcttacaacaaattccatccaaggaacctgcggtcctcatgggaattttaggtatttacaaatgtacttttactcataagaagttgggaatcaccaaagagcagctggccggaaaagtgttgcctcatcttattcccctgagtattgaaaacaatcttaatcttaatcagttcaattctttcatttccgtcataaaagaaatgcttaatagattggagtctgaacataagactaaactggagcaacttcatataatgcaagaacagcagaaatctttggatataggaaatcaaatgaatgtttctgaggagatgaaagttacaaatattgggaatcagcaaattgacaaagtttttaacaacattggagcagaccttctgactggcagtgagtccgaaaataaagaggacgggttacagaataaacataaaagagcatcacttacacttgaagaaaaacaaaaattagcaaaagaacaagagcaggcacagaagctgaaaagccagcagcctcttaaaccccaagtgcacacacctgttgctactgttaaacagactaaggacttgacagacacactgatggataatatgtcatccttgaccagcctttctgttagtacccctaaatcttctgcttcaagtactttcacttctgttccttccatgggcattggtatgatgttttctacaccaactgataatacaaagagaaatttgacaaatggcctaaatgccaatatgggctttcagacttcaggattcaacatgcccgttaatacaaaccagaacttctacagtagtccaagcacagttggagtgaccaagatgactctgggaacacctcccactttgccaaacttcaatgctttgagtgttcctcctgctggtgcaaagcagacccaacaaagacccacagatatgtctgcccttaataatctctttggccctcagaaacccaaagttagcatgaaccagttatcacaacagaaaccaaatcagtggcttaatcagtttgtacctcctcaaggttctccaactatgggcagttcagtaatggggacacagatgaacgtgataggacaatctgcttttggtatgcagggtaatcctttctttaacccacagaactttgcacagccaccaactactatgaccaatagcagttcagctagcaatgatttaaaagatctttttgggtgaggtgtcttacttctattttgaaggattatttcagtttcaatcatgggtgagctgatttacatctttatatagttggcttggaggaagtacttctatgggaaagtgaacagttctgtgacaggaaacatctctgtccatgccagcatagtagttgtatggacttctaaccagttgagttttttaaagcattgaggattttttcctcttaccaactcctcttcaggtttttaaagacccagcccttcccaatctcaaagagaaaaaggaaactgagttatcttgaataacataactttttaatcaaatgtttattttggcttgtggatcttggtgttatttaaaaaattgaggtgatggtcattgcaagctcatctattaagtactatatggtacacagtctatgagtcattagtcttcattttaatatgtaaaaaatcttgatgctgtattgatttgtttgcatttaagatgacagtgagaaaatgataagcataaagagaagtatcaggttatttgctttttccaaacttttcagatgaactattgtttagtacagagactgagcaaatactacaaaattcaacttaaccttcatttcattggtttaaatgcgttattaaccatcttaagtgcaaactaatcattgtaaattatattttagcatggtctgcctcaaatagtaatgtatttttctgcattcacttggatatatttagaatcacttttttcctcctgtatcaaggaagaggtatgtgctgatttgtttggatatttgacaaggcactctgatgtgacttccctgactactaccttcatatttcatttcaaattcaaacttctgaggttgcagcatatatgaattgcattttcaaaagaagatttgtaagaattaaactatatttatgagtaaacttttgaggtttctgctgtattgtttcaaatgtaataaactttacttctgtaaaaaaaaaaaaaaaa

SEQ ID NO: 1031 - DNA, 1874 bp, Homo sapiens
gcatttttaccaaagagcaatgtcactataacttatgaacagaaagttgtgaaatataagggtactcatggaaaccagtgaagagaggaaacaccggcaattgttcaacacggaacagtgagcaggtactttgggagtaaggctctgagagatggaagacgctggtctcagatctgaggtgatgtctggccaatcgtcttggctccaagggggaagaatgcaactggcaggattcgaggagagggcacttctgcagcccccaagcaagtctctagttttcgccccaaagtggatgcactttctaacttcagcaaggcctcctcaggaggatttgctttccgatgtgtagtagcggtacaggaaacctaagagaacagcgcctatgatgggtaaaatccaatatgcccagcaacttttgcatgtatcattttttgaagggtccttgctaccactttcaggtttaaggtcactcggatggatatcaccaatgtagtactgctttagcatttctctggcatcagaagagtgtcctacatcttcaaagctttcacttgcatctacaccagcttgttccagcagaacctcttctcctccagggtgctcgttgaggaagcgggtgacatcgtagactcgcccatggatcacaagccacagttccttcaaggagttgcgctttgccacctcctccaaccggtaataggtgactgaggtctcgacttcctgccctttcccatcgctgccgctagcttccgcagtcgccattgaaccggacatactgcctctccaccgctaactgagattccgcgactactttccttgagagcccgcgctcagccttcctcggcttccgtaacagtggagcagccaagtttgtcttcaggcacaatgaccctgaccacctaaagaaacttctagagaagtctaaccctaagatacccaaaattgtggcctttgagactgtccactccatggatggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtggagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacaaaaaaaaaaaaaaaaa

SEQ ID NO: 1032 - DNA, 3051 bp, Homo sapiens
aaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagtaaggaccttctccccacaatgggtccctaggcaacaaccatcaccctccctccttaagcttctgatagcaggcactggtatctcagtttacatgtgagtgctagttggggaagaggtctgatggctgggaaaataaccacactgggatgaccttactcttttccttctgaaattgggtcctcctccaactgggggttttaaacctatatttggactctgggccctttgaataagctctggacattctctttagaaaagtacatatatgcataaaactcctgcaggcaatcacaagtaagtcatgtatctctgaaagccccagactttttcaagtgtagtctacaaacctcctataccagaatcacctgagatgcttgtttaaaatataggctcttgaattccactccaaatatgctgaactaaggtatctgggggagcagggcctggaaacctgcattttagttaagtgttccaggggattctgatgctggtgatctcatacctgaagaagcctagttctgctagagattctcagactgtgggcatcaatcacatagcaagcttttcaaaggaggactccagatacggcaaattgcaggtttggagtggcccccgggagatgcattggtagcaactccccagcttattctgatgcagatggtcaggatggtggtgacaggtgtggggtaggagggctgagaaatgtgtgaggctggcacaaatgaaatgggatctgcacggaagcctccagcatgggcactgcagtgccgtcctctctcttctaggttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgtttttactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatgaaaaaaaaaaaaaaaaaa

SEQ ID NO: 1033 - DNA, 2305 bp, Homo sapiens
ggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaacaaaaaaaaaaaa

SEQ ID NO: 1034 - DNA, 938 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaaaaaaaaaaaaaaaa

SEQ ID NO: 1035 - DNA, 826 bp, Homo sapiens
gcggcacagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcacttcccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaaccgtgactattaatgattgataagcaccagtgaagaagttctaacttttagcatgctgcacagaaactggtataacatgccttcagtatactaacactccatatgctcagttttgttttgttttggcagttgacaagaagttaatttgctttagtaaaaatccctcattccagcctttctatataaatagctccttcctgctgttttaatgtgggtgcacactatagcctcacaacctggttaatccagtgtaatctgcagtgtcgtaactaaagtactggcttggtcctaattg

SEQ ID NO: 1036 - DNA, 1042 bp, Homo sapiens
tttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaa

SEQ ID NO: 1037 - DNA, 1284 bp, Homo sapiens
ggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttggaatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagagtttgt

SEQ ID NO: 1038 - DNA, 918 bp, Homo sapiens
agatcttgtatctaatcatgtctctaactttgcataaagacagggatttgtcccagcttaagggccaagggaagaactcgcatagaaatagttcagtggtagggacgactggctttgttgggtgagtatgtggtggtgtccctgtggctggacatgactggtgtttcggagcctcgtcatatccgctaacaggtcaaaatgcagatcttcgtgaagacccttaccagcaagaccattgcccttgaagaggagcccagggacaccatcgaaaatgtgaaggccaagatccaggataaggaaggcattaccccggaccagcagaggctcatctttgcagtcaagcaggtggaagatgaccgcactcattctgactataacatccagaaagagtagaccctgcacctggtcctgagtctgagaggtggtatgcagatcttcgtgaagaccctgactggcaagaccatcaccctggaagtggagcccagtgacaccatggaaaatgtgaaggccaagatccaggataaagaaggcacccccccacccccagccccgaccagcagaggctcatctttgcaggcaagcagctggaagatggccgcactctttctgactacaacatccagaaagagtcaaccctgcacctggtcctgcacctgaggggtggctgttaattctccagtcttgcattcgcagtgcccagtgatggcattactctgccgtatagccatttgccccaacttaagtttagaaattacaagtttcagtaatagctgaacctgttcaaaatgctaataaaggttttgttgcatggttaaaaaagaaaaggaaagaaacagctcagtgttgcaggaaaggcctggatcattatttcaaaaactcaatttctcagactgcttgtccttgaataaacaatatctc

SEQ ID NO: 1039 - DNA, 602 bp, Homo sapiens
aagtgggagcttttggtgtaaactttcctgcagccgttaaagtggcaccggtgcaccctcctcctgccgtcgggggaggcatcgccatttcccttgtcacctggcttccccgaagtcccgctgcgcaccttccctggcgagggcagctccccgggcacgcaaccccacagttgagaaggttccctgctcagttccggagaagatggaggcgtggaggtgacagaggagctcaattttcccgagctgaccaaaacttcgccaatggggtcggaggtaaacttggccgtgggagaaagttcctcggagctgtcagaggattcgctgctgacatctgagttcaggctgttggtctctaagttgtaacaaaagctcgggctgatgagagtgtcctctggaggactggaagatatcttcagttcggattcctcctttttctcccgagccagaatgattttggtccacagatcttcctggctgtcaaatttgattgctgaggctgaaacatagcagggctcgctctggaggtaacgtgccagctctagggatgtcttgtgtcagtactccttcagagactgcagcagcctataagtatccggatcttg

SEQ ID NO: 1040 - DNA, 899 bp, Homo sapiens
cagaatgtttaattctggtaaagcacatatgcacatacttcaaacacggaaaattaatctggaagtgaatgccataacagatcagctactgaccatcatgcagcaagaggtgaaatggacccacggtggccctcaggaccccacagtgcctgcaggaagggtgaaaacccaggaagctgaagccctacacgctgccgaggaaaacgcaacagacatggcaggtgcctcacgacaagaaacacttacaaatagaatcaaaactgattcaagtcatacagtgaaaggacaaaaggaaaaaggaaagagatcaatatgatccgaaacaatcgttttaagagtaagtggctgaccttctgctggccctccagtccgagatgcctgagggtgagctggtgctcctgcacggggccgccctgaacagcaagcgcactccgtctgttgcacacttcgaatcctgaggtccaccagcaaactctggctgagcattgagcctgggaagtgcccagatggtgacggtcccctgggcttcccgagactcgctgagtctcttcaggtcctaggcctcttcgtccagggcccaggctcctctctcccctcagctttccttttataaaccctgatgtgactctgcggtttcctgtaagactctttaagaaattacctcgcttaggtgaactgtgtgggctttcacaggtgtgtgtggcccgggccctggggaacgccatctggtcccggacttttgggcccctcctttcctcaatttaaaggggttgcccccccccagagtaggatccgcccccctgccttaaaccgggcccaattcacccactggttggagccaccaggaatggcttcagggtccctgataacacgggaaaatacccacacgccgggaagaa

SEQ ID NO: 1041 - DNA, 1496 bp, Homo sapiens
tgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggaccctcatctctctcctcaccctgctgtgactccaccacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttggagcaccttcgggatgaatcaggcaacagctactctcctgaagagtacgcgctgcaacaggctgccgatgggaccatcttccttgtgccccgggggaccaagatggaggccacagactgagctggcccagagggtggaactgctgatgggattttccttcattcccttctgataaaggtactccccaaccctgagtcccagaaggagctgagttctctagaccagaagaggatgacaa

SEQ ID NO: 1042 - DNA, 1488 bp, Homo sapiens
ggcgagcggcccccttttttttttatttattcttttggcttaccttcttgcttaatgggaattggttaatggtctaagcacattagaaggccaaaaaaggagttttcccaaacccagcaaactcaaggtgctgtggattctgaacgtgccaaaagaaaactgcatttcccctcttaagtaaaacgaaagtgagttttctataggtaaagtgtatctcattaagcccccagaatttaacacaacaacacaaaaacaacaaaacaaacaacacaaaacacaacaacacacaacaacaaacaacaacaaacaaacaacaaaaaacaaaccaaacaaagagagagaggggcgcgcacagactgaaaaaaaattccacccgagagagaggagcagcccacaaaaagtaaaacgcaagccacacacgcaaagaaacaattatgtacaccagagggagggacacaaaataaaaagagcgagagaaaattatcttacaaaaaaaaaaagagcagcacgggccagcacgattacaaaaaaacgataaagaaaaaagagagaacaaaaagacgagaacacagaaggaacaactaccattcaacgtcaaaaaaaccaacaccacaccatagcgagagggcgggacacaataaaaagtggcagaacacgacaaacaaccaacacaaacaaaaaaacaaaaaaagcagaaatacgagcaaaaaaacacaacaaacacacactaaaaaacaatcatcaatcatatctcaaccaaacactaccaaaaaaaaatcaataaaacataaaacaaaaaaaaaaaaaaatcaacaccacaacaaaacaatattatcctcattaaacaacaaaaatattaccaacagaacccatcctaccttaaaaataaaaaaaccatacaaaaaaaaaaaacaaaccaaaacaatgacagaagaaggcgagacacagagatggaggacacaggatatacaagaaggagagagaagagagaaaagaaagcagaaaacaaaagtaagaagtcagatgagagaaagcgacgaacggcgaatggcaaaaagcgcacggcaacggatacagcgaaaaggcggaaatagacaaagacaaacaaggaaacaacaaatgtacgcgggaagaagaggcgaaaacaaaggcggaaagcgaagatagaagacaacgaatgaaacaagtagcaaagaagaaaaaaacaaacaaaataactataatgacacaacctactcacaaaaaaaaacaaacattacacgaacgagacacaccacaccaggcacctgaaccgacccacacaacgacaccacacaaccatgcaaaataacaaaataaacatcaactcagagatgaaacaaacaacacacagatcgatctaaattcacgcaaacaacaatacagatcgacaacttacaacaaaaaaacagaaaaacgctaacaataacaaaacacaaagacataattattattttatatacagccacg

SEQ ID NO: 1043 - DNA, 6456 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatccgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgaacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 1044 - DNA, 2976 bp, Homo sapiens
ggaagaagtaggggcggggggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgtatccagaccctagtgggcaacatccacatcaagcaggggatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaaaaaaaaaaaa

SEQ ID NO: 1045 - DNA, 527 bp, Homo sapiens
agttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgtt

SEQ ID NO: 1046 - DNA, 518 bp, Homo sapiens
cctttttaaagaaaggctttattgctgcaattagacatcccagtgtatagcacaaacccccctgtacagagaattattcaagtggtaatactgagaaacagtgaacacacacaaaagaatacaaaactagacatttagatcactagaaactttctaaggtaagaaaaatttcaaatgtgaagtgccttttagaaactacaccacacatgccagtgtaaatttggtttaacaatcaatttctataaacattgcatctaactgtgcactgatcaactgcacaacttcaacaattacttccaagacaaagataaatgcttttatttccctatgttttggtctttccttgggctagagacagaagctgcatgtttcaaaccagattcaaaagggaaagcacttcaaaacagaaagtacttcaattgtgtatttgccttcagccacatccagagacttgtggatctcacccggttggtcccagcccttctccaaccctgaagcccacagcaggggtgcagagg

SEQ ID NO: 1047 - DNA, 1613 bp, Homo sapiens
ggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggggctggcgctgcaaccggtgtacccgggggccggcgccggctcctcgggtggctacttcccggggaccgggctttcagtgcctgcggagtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacaggggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaaaaaaaaaaaaaaaaaaaaa

SEQ ID NO: 1048 - DNA, 576 bp, Homo sapiens
  misc_feature 47, 51, 84, 411, 530: n = A,T,C or G
ccaggatggatgggggtatgagattttgggggttggccagctggtgncagncttttggtgctaaggcctgcaaggggcctgggnagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccatagctgtgggcaccccagtnctaaccttagaaagggggcttcaggaagggatgtgctgtttcccttctacgttgcccagtcctagcctcgctctaagacccaggggctgggcttctaagtttccggtcaagtctttaangcaagttctgtgttaagtcatgcacacacataccctatgaaacctt

SEQ ID NO: 1049 - DNA, 483 bp, Homo sapiens
  misc_feature 433: n = A,T,C or G
aacggtttgtattttgttttatttttatttagaagtagagaatacagtaatagtgaggcaggagaacagggaattaggatagccaggggtaggggcataagcaaaggaatagcaggtgcagccagtttgcataaacaagagaacagcaggtgcagccggttctaggcaagatcaggcagcatgcaggccacatcctcatgcctttatcagtcggcgaatactgtaagaaattaagaggatcgttccaataataccagccatcacacacaaaataatgagtattatcactacaggagctggtacagtgaaacgatggacaagttgtcccgtttctccatttgtctgtgatgagatgtaactctttgtgactgaagaagaagttgaagtgtgcattgccacctcagtggtacttaatgctgatatgctcacaatntctgacaatagtaatacaaagaattatttttccatacatccttgagatca

SEQ ID NO: 1050 - DNA, 674 bp, Homo sapiens
gcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaataaagactgataattgcttctgtagtactccttaagaacacaaaacggggggagggttggggaggggcggcaggaggagagaaagaagagggaagggtgggggaggagaggaatgagagggggaaaggggaagaggtgagaggggggaggagggagagtgggaggaaagaggaataggagggaagagcgagtggtaggaaagagaagtagaaagtggaggaggggagtattgaggggagagggatgagaggggagtggatgtataggaggctgtgtggcgacggtagaaaaagatggaggggagcattaaaatggacgtcagaagatagagtgtgataaagatggataagttgaagaatgattcagtggtaatacggaaaaggtgagatgtgaatgaagagggatacggaaggaaagtgtaggggggaggggagggagatgaaaggagaaaggaagagaaggaaggatgaagaggaagatagagggggtaagaagggaagagaggaaggagagagggg

SEQ ID NO: 1051 - DNA, 527 bp, Homo sapiens
tttttttttttttacattgtataatttaaaagctttatttccccccataatttgcaaatagatttcatattagttccactggaagttttcttcgtacagttgcctttctcattgactatgctgttggtggggaaaactgctttctcatgaggggaagggttagatttcatagagatgctctgagctaatcacataaacaagagggtttgacctggcagcctctgaggcagtcaaggaggtcaagaaatcctttcagctaaaggcctagtcaggtgggactagttgccaggatcctctctgcagaactgcccaaacgtagctctctttgaccaggaagcctggaagtcagaccatcttctcaggccctgccaaattcccatcctcagtcctgtggcctcatgcgggaacattttatccaagcaaaccactggctttcgccttgaggtccaatgtgcactcttcaccaagtgcaagattgatcttcactccaaagttcaccgttcacacagtttttggcttgtgcttta

SEQ ID NO: 1052 - DNA, 345 bp, Homo sapiens
tttgtttctattggtttgcatagtatttattgtttttcatatacacaaggctgattactgtacagtttacactttgaacacggactatgatatagtgcttgaagacatagaaaacctcttctctatggacatgctggtgcaatcctgggtcagccaccggcctgtcccccaactgagagaggagaccctttcagatggggtcctggctccctttgagtcctacaggtaagcctgggggtcctcgcctcagattcttaagtccctaacacaaggaaccccgaatgcactcttcaaggtaatgattttccattggaagatgattcgtattgaaattggcagagagag

SEQ ID NO: 1053 - DNA, 1357 bp, Homo sapiens
tctagagaagccaatcagcgtcgccggggtcccagttctaaagtccccacgcacccacccggactcagagtctcctcagacgcggagatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacacttggcagacgatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccct

SEQ ID NO: 1054 - DNA, 2600 bp, Homo sapiens
agttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacacacacacacacaaacacacacatttatcatttaatgcataaatcaacacaaaaggttttcccattaatatgaaatattacatatatataagtgccatatttaaaataatttgtctaacagtagaactgtgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaattaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttattacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccca

SEQ ID NO: 1055 - DNA, 1576 bp, Homo sapiens
atccaacccctaacattcaaacatgattaaaaacacccaggacacttctcttgctggcagaggccacaccccagataatggcagtcctgccaaactctggccagagatagggacccaagctgactgggtgtgagcacgtaaggagaccactctgccccatggggagaatcttccagggctcagctgaggctcagagcccaggcttatgttattccccatcaaatgccagtgattcctccaaacattccccacaagggagaaagggaggaggaggcagagagcttatcaagaggttcaccctatatggggctggaggttggatctactggggtgaggaaaagggtgtagaggattggggcactggggcaggggcgctggcacattcctcagattctggcatgtcatcctggaagtactcagcctggcggtactgccacagacgcaggttcccgtcccacgaactgctgacaatcttctcttcaaaggggtgccaactgacgtcacgcacacaggccttgtggttggtcagcttcttcacaatgtggccacttagaaggtcgtacacaaccactttgccagtggagcagccactgtagatgaactgctggccagtgctatgaatgggggagaaccggcagcggatgagggtgtgcagcactccgtggccccggtaggtcatcaaggagctgtcccctgggagcttcagcttccgccaggcttttttgggcacttgctgccaccgatagtcccagttttgctgtgtggcagcctggcgtgaagcttccatgccttcccggctggaaaagcgtcggatatcccagagtttgatggtctggtctttagagttggagatcagataccgggcatcacccttgctgtcaatgaaggtgatgccatcctggtgtccagccagtgcacccacaggcttggggtcatcctcccgcatggtgcgtcgatcccacactttgcagatggcatcatctcccccagagaacaggatttgggagcttatatcagcaaaggccactgcattcacatcatcctcatgggactcaatctgaagggtgcgccggttctgttctcggtcaaagacatacaggcagccatcattggcccctcctagtacttctcgtccatctgaggagacagcaatggagaagacagcaaagcgacgctcatctggcctgagatccagggcagtgtgtgtatctccctcaccatagatattgcagatatgaatgtaatcagaccagctagagtagaggaagtggttcccatcaggggtgaaggccacatccaagacgctccagcctacgtcgcgggccttgatgctcttgaatttacggaaacggccatatcggcagtcatagagtcggattgtctggtcttggcaagcagacatgaatatttgaccatctttgctgtagatgccacagaaagccttctgagagtagctatcagtgaagcccagatcattgggcaagaagtgagatatcactcgacgaattcgagctcggccgatttggcctgatccataacttcgtataatgtatgctatacgaagttatgcggccgc

SEQ ID NO: 1056 - DNA, 3272 bp, Homo sapiens
cacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 1057 - DNA, 774 bp, Homo sapiens
atgtgagtctgcactgactgattgaaacagtaagaaaccccacatgtgctaaggtagctgcggtaagtaccatagtaaatagagggataacacccaatagcttttgtgttcagaaactatggtcatttccctgtaatagactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagcgtggatcagctgcagttggaagggttgaaatacatagaaagaaatgagcaaaaaatgaaacaaagttgcaaaaaatattaagtcagacacaacaactctgcagaacattatgattggctaactcacaccctgattgtattgaacgacttccatccttttcaacattggtgatgcactctctgctattgtctctacatgaaggctgttgacatcaccactccatc

SEQ ID NO: 1058 - DNA, 5963 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaaagtacaaaaaaaaaaaaaaaaa

SEQ ID NO: 1059 - DNA, 774 bp, Homo sapiens
agggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaacttcctgat

SEQ ID NO: 1060 - DNA, 1105 bp, Homo sapiens
gggcgaggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaa

SEQ ID NO: 1061 - DNA, 258 bp, Homo sapiens
atgtatggaaaaataatctttgtattactattgtcaggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 1062 - DNA, 756 bp, Homo sapiens
ggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccaggaaccagtgggaggaccggatccaggttgtggcatgcggaacaccgtgggatgctcaaagataatgtatgttggaatacctgaaagatgctcaggacctggaaatgtctggaatcaactatttcgagataaacaaaaaaaaaaa

SEQ ID NO: 1063 - DNA, 702 bp, Homo sapiens
  misc_feature 667: n = A,T,C or G
tttttttttttttttgtgatctcttagcagaatagatttattatttgattgcttgcagaataaagcctatccttgaaagctctgcatcatgggcagtgagctcagtggtatctggaggacagggcactggccactccagtcaccatcttctgccaggaagcctgcacctcaggggtgaattctttgccgaaatggattgccaaaacggtcaccagcacatttcccaggagcttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggttgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggacccgactggagagatgaagatcacctacggccagtgcggggatntactgcgggccctgggccaaaaacctaccaatgcc

SEQ ID NO: 1064 - DNA, 1198 bp, Homo sapiens
cccacgcgtccgcggacgcgtgggcgcgcgggagctgggaggctgcgagatccctaccgcagtagccgcctctgccgccgcggacttcccgaacctcttcagccgcccggagccgctcccggagcccggccgtagaggctgcaatcgcagcgggagcccgcagcccgcgccccgagcccgccgccgcccttcgaggggccccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaaaaaaaaaaaaaaaaaaaaaaa

SEQ ID NO: 1065 - DNA, 1119 bp, Homo sapiens
ggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaacgtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggt

SEQ ID NO: 1066 - DNA, 583 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcac

SEQ ID NO: 1067 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 1068 - DNA, 3396 bp, Homo sapiens
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcagattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgatccaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 1069 - DNA, 890 bp, Homo sapiens
aggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaacctttgtaactttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagtttttgttctgtttttgctttgcatttggagaaaatattgaaagcagggtatgttgtttcattcaccttgaaaaaaccatgagtaaatggggatatagaatctctgaatagctcgctaaaagattccaggcagggacatgaattttgttccatctatcaataatttccagaagaacacttttttaagagtccatagcaaaaagcaaaaaaaaaaattctaacccaaagttaaataacctttgtaaagcatttcggagagctctaaaaagatgtttagaagttcccccggtcccttccaaatccacgatcaggctctttctaggggggtaccgaaccacccaatggtctcattattcaagccttacatgttgccgcaacaagggcgctccactttggccgcga

SEQ ID NO: 1070 - DNA, 1211 bp, Homo sapiens
ggaaagctgccatcagctgagcaagtccaccaacagtttctgtgtcccacttcatctttaataaggaaaacaaactcaggaagaaaaaggaaagcagaagtgatcaaggagagcgctcgagttgcaatattttcctttggctgctgacaggcagttactataaagcattgtgcatggtgacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgacctttttggactcatcagtgtgacactaaatatgcttcctttggtcaagaaagctcaagggagagttattaatggctccagtgttgggggtcgccttgcaatcgttggagggggctatactccatccaaatatgcagtggaaggtttcaatgacagcttaagacgggacctgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggt

SEQ ID NO: 1071 - DNA, 1218 bp, Homo sapiens
attttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgagaggataatgtgaaaaaaaaaaaaaaaaaaaaaaaaaaaaaaaaaaaaaaaaaaaaaaaaaaaaaaaaaaaaaaaaaaaagagaggggggcgcgcgcgcacaaaaactatctccccgggggggcgccaaaatacacgcgccccccgattttttttgcaaacaaggggggccccaataagaggggagagcgatatatatatataaaaaaagagagagagggggcgggggatcaaaaaagagagcaagggggaaaaacgtcgtaacaggggacattgggggaaaagagaaaccacaacggaggggggggcgcggacaatactgcggcgacacaacacacaaacagaaaatactaaaaagccccacaagggagaaaaaaaaaaagctaaaagacgagaacaacacggtgaacacacaaacgcaacaaatcaactcgcaaggaaacaaactttgcagacaacggggaataaacaagcacagacaggcaaatctttcacacaggggggcgtccgcacgtgcaaccaacacaacgacaccaggacacactcagatgaaacaaacaaagacagaaagaaagacaagaaaaaaacaaaagaacaaaaaaaaaccacacaacaaagagcacaaaagaccaaaacacacaaacaagaagacaacaatcaaaaaacagaaagaaaaaggagacaaacaaaaagagtaaaaaagaaaaaaaaacacaaaaagaacaaagaaaaaaaaaaagaagaaacaaaaaaaagaaaaaagacaaaaaaaaaaacacacagacacataaaataaaaaaaaacgaaaaacaaaaaacgcagaagagaaagcgcaagaaagaacaaaaatgagcaagcgacaacaaacaatatcaaagcacaagacacacaaaacaggaagaaacaacaaacagcaagtaaccacgaatgcagcaaacagaaaaaacagcaaaaaaacaacaaagaa

SEQ ID NO: 1072 - DNA, 244 bp, Homo sapiens
agtgactactacatgacctggatccgccaggctccagggaaggggctgaaatggtttcatacattagtagtagtggtactatcttatccttcgcagactctgtgaagggccgattcaacatctccagggacaacgccaagaactcactgtatcttcaaataatcagcctgagagccgaggacacggctgtctcttattgtgcgagagacctcccggaactgccactgaaggtggaggctactgg

SEQ ID NO: 1073 - DNA, 214 bp, Homo sapiens
ggatccctgagactctcctgtgcagactctggattaaccttcagtagctactgaatgagctcagattcccaggctccagggaaggggctggagtgagtagtagatatatagtacgatagaagtcagatatgttatgcacaatctgtgaagagcagattcaccatctccaaagaaaatgccaagaactcactctgtttgcaaatgaacagtctga

SEQ ID NO: 1074 - DNA, 262 bp, Homo sapiens
gcctctggattcacctttgatgattatggcatgacctgggtccgccaagctccagggaaggggctggagtgggtctctggtattaattggaatggttgtaccacaaattatgcagactctgtgaagggccgattcaccatctccagagacaacgccaagaactccctgtttctgcgaatgaacagtctgagagccgaggacacggccttgtattcctcatactcctaggagttcctcggggggtagtccgagggactactgg

SEQ ID NO: 1075 - DNA, 2939 bp, Homo sapiens
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaaggaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaaaaaaaaaaaaaaaaaaaaaaaaaaaaaaaaaaaaaaaaaaaaaaaaaaaaaaaaaaaaaaaaaaa

SEQ ID NO: 1076 - DNA, 511 bp, Homo sapiens
tttttttttttttttttaaatttatattacatatttattaaggcaaggaactatatagaaaaacacatttgttctgcttaaggcatacttgggaataaaccattgtacaaattattgcacatctgaaaccacagtgcataacagactgtctgcataaaaatgctaaagaagtaaaccaggtatattacctgacttaggtcataaatgttgatcggaagacaaatatagattttcctagtcaaagtatgcagcagtttgaaaactttggcttccttgtttggtacctttagaaccaagactcaccaagcaccatcatttaggctatttaaacatgttttctgtacctgaatttcttcctcttcttctaacatcataataatggcttttagaaggtaaagagaatacaaggtgatcttttatgcttatattgcatcaatacacaattcaagggaattctggtcttccctcccccaactcacggatataatttataccctgatatccacaactt

SEQ ID NO: 1077 - DNA, 1789 bp, Homo sapiens
ggttcaggaacctgctggttctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggcccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactgataataaaaatcagactgaaagccaggacatctgagtacctatctcacacactgaccaccagtcacaaagtctggaaaagtttacattttggctatctttactttgttctgggagctgatcatgataacctgcagacctgatcaagcctctgtgcctcagtttctctctcaggataaagagtgaatagaggccgaagggtgaatttcttattatacataaaacactctgatattattgtataaaggaagctaagaatattattttatttgcaaaacccagaagctaaaaagtcaataaacagaaagaatgattttgagaaa

SEQ ID NO: 1078 - DNA, 3055 bp, Homo sapiens
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacacccaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctgaaagacataaaaatctttaaaaaaaaaaaaaaaa

SEQ ID NO: 1079 - DNA, 595 bp, Homo sapiens
  misc_feature 497, 506, 523, 571, 579: n = A,T,C or G
ttacatgcaatacttttattttagacatgcaaggaaagctatttcagaatctactaatttaaagcaagcagctgtatacagacagcaaaagaagcaacattttgttacagcttagcacaaggcatccaacacaaacaggcatgagacaatgcatatttatgtagcattaaaaccagatgaataatatattgtggggcaggaggaggaaaggaggggaaaaaaaaatagaaatgaaagaccaatgtttctcaatgcttccaatatataatgctaaatttcccacctgattgatagcacatccaggtgcttcaaatgtcgtgcattacagtgagaatgttaagaatggaaaatcttatctgtgtacctgcctaatactaagtttggtcaaaacacattttcatagatcttctttcagtgataaatcgatttgaacatcttgtgaagttattgtttaataacttacttaacttaggctttatgctctctagatataaacnatgaattcntttccctttataaaaanatatgctgcatggtttattaaaagaatatgccatagttacccatattnaaggtttnaaatccggaatataat

SEQ ID NO: 1080 - DNA, 870 bp, Homo sapiens
agtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatggtgagcattgaaactatgcacctataaaatactagatatgaaaaacgagacaaacaagaaaaatgaataaaaacaaggggggggggggaaaaaataacccgcggggggggccaattaagcggttacccgttttgtgtaaaaggggcccaaagagggggtataagaaagagaacgggggggtataaagggtggaggcgaaggtgtgggatttgggagaaccctccgggggggaatgggaaccc

SEQ ID NO: 1081 - DNA, 735 bp, Homo sapiens
  misc_feature 317, 530, 627, 642: n = A,T,C or G
gggcgggggggtcatgcgctcgcccccccgggagcagggggtccagcttgtcgagtccggggcgccccttccgagtcctgggcaccctcgggggggaatccccgggggccgcgccctctctgagttcctgggcacactcggggagggggggtccccagggccgcaccctctccaagtccggggcgcccacgacacccccccgcgagcccgccccttggggagggtggccgcgcatgcgccccgcgcgcggactcagtacgcgggcacctggtgctggggcagcagctggcagccgctgttgacgtggctgaggactntctgcttgagctgcgccacctgctcgcgcagcaggctcgccgtggacgccagctccgtgttctgactcttgagggtcttcactttctcttccaggcgcgagatgcgctccagcttgcgcttgcggcacttggaggcggcgatgcggttgcgcagccgcttgcgctccgccttgatgcgctcctgcgtgtccatgtcgatggggcgacacggcnggctctcgccgaagctcggcacgtcgggcaccgtctgtggctcgttcctgagcgccagcaggagcggcaggccccaacgcggcctggggtggcggcnagcggaagggcacanggtccgcagcgaaggcgaacgtcgcgggccccccggcgccccggggcgcgcgcgtagcttgtcaagttcgcgtagacaggcgctttgggcgcg

SEQ ID NO: 1082 - DNA, 1507 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattccc

SEQ ID NO: 1083 - DNA, 1769 bp, Homo sapiens
gcccacgtctggttcaggggctagaaaagagcgtcgatgccggcggcagtgatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaatgggtgcctgtggaaagctcctggcgtctaaatgagcgtcactatggggccttgatcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaaaaaaaaaa

SEQ ID NO: 1084 - DNA, 1865 bp, Homo sapiens
cgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtctgtaaaaaaaaaaaaaaaaaa

SEQ ID NO: 1085 - DNA, 577 bp, Homo sapiens
tttttttttttttttttaataattctatacagaatcttcagatgatgggaccagcccatttagaaatcagtggatatgctgtcgatatgtaaactgaaatcttgcaggcttttcaacactgcttagctagactttctctactgagtttctacaaaaagaccagcattggaggggtaccaaatacaccgacaaaagagaaaaagcagatgggctgctaggtttctgcttttaaaaaatttcatataagaattgggtttcaagcaggaagccagaacttctgcctctggttcttaaattaacattcggtgtgtaatggacaataggcagggactcataatttgactaactcacatgctcaagcatgatcgtgtccaatttctacaggcctcctttgtaaagaaatgtgtaacaatggggggaaagtcataattctacctgaaaacatggattgtaagaggaaataaaaaaatcaaacagtatgttttaagtttcccttttgatactgtgtttcagggtaagtgacagcttctgcaaaccaagactcagtcctgattataaaggatttttaaaattacat

SEQ ID NO: 1086 - DNA, 2633 bp, Homo sapiens
ccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccgggccaggcagaatattgtgaatgccaccgccaacctcggccagtccgtcaccctggtgtgcgatgccgaacggttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttcgaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagtgggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagc

SEQ ID NO: 1087 - DNA, 1100 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgaga

SEQ ID NO: 1088 - DNA, 2242 bp, Homo sapiens
gaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagaaaaa

SEQ ID NO: 1089 - DNA, 5190 bp, Homo sapiens
gttctgctggccaaattgtttttccttcaagtcttaggagcctgcctgattatgttcctcctattccgcatcctcataaaattactgcgacttccaaaacacttggcacattcttatttgaatacattacattgttgtgtaattatcccttggccccctcccccagcactagactctaagctctttgaaggcagactatgcctattcatctttgtatttctagccctgggcccaacacccagaatttcttgtattttcaatatatgtctgccaaatgaattagagctaatgcctgaaggagaataagtttttttgagaaagaggaagagccaggagggaggagaaggcagggtccgaagagccctgggggtttacttggggaagatgcggttccccattgcagcattctgccaggaggtggcactgctctgaagagccagctggtcgcttacagactgaggctgacagcttgaaaccaaagagggaactccaccaggaagcaacattcctccactgggcttcccagcccagttacatgccatactctgccctggtcaaacagccaagtcttcaggaggttactggccccaggcgtctccccagtgactgatgatgttaaaccctacgcttctctgattggtttagacaaaatgacaagggcacctattggaaatgatctggcaaaacatgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaaggtaagatggtactcctatttacttccatcctgaacctagggagcccactcagctttgtgaggaaaagcgctgtgctttgtgagtggtgggaagtcttatgaggcagtggaaacaacaggggagtggggaaagacagctgctatgtgtggttggtaaacgatatcagtgatgctttgcatgttccatttaagacaatctcttgaagcggagattgttctctccattttacaaatgaagaaaatgagactcagagttatttgtgcaagttcacaccattggaaagtggtagagctgggatttgaacaaagtgaatgttattttcactcctccactcaagattctactctgctttctatcattaacttatcttgtgattcttgaaaagtgtcttagtttccttctctgtagaggatggggcagaatggaagaataatctggaagatccctcttcctccaaatgtctgtttttctgggtattgggttaaaggtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacaggttttccaatttaccatttgtgtctggggatagtgggaggcagtcccatctatggcttggggaggctgtagccattcctcctctttcccttctaagagtgagaaacccatccatggccttctctagtcaatacagtggcctggtatgaattagacaaaggaatcccctttgggaggatacagccctatgccaggatgtatggcatggtgagcagaatgcaggctttcacttgcttctttggctaggtgtctttgtgcagcccccaaacacacaatgaacagtgactctgaatctgtcactttattttatatatatacatttttaaattttttatttgatttaatttattttttttgacacggcatctcgctctgtcacccaggctagagtgcagtgacgtgatctcggctccctgcaacccctgcctctggggttcaagagactctcctgcctcagcctcccaagtagctgggattacaggcgcatgccaccacacccagctgatttttgtatttttagtagagatggggtttcattatgtttgccaggctggtctcaaactcctgacctcaggtgatccacccgccttggcctcccaaagtgctgggattacaagcttgagccaccgcgcccggcctttatatatatattttttgagacgggctcattctgtcacctgggctggagtccagtggcacaatcatggctcactgcagccccaacttcctaggcacaagcaatcctcctgcctcagcctccagagtagctgagaccacaggtgtttgccaccacacctggctaagtttttgtattttttgtagagacggtctcgctgtgttgcccaggttggtcttgaactcctgggctcaagcaatctgcctgcctcagcctcccaaagtgctgggattacaggcatgagccaccatgcctggcctgaatctgtcactttagaaagtagaactctttacttttgccaactggcctttttataggcaggggaagcttggagagatgccataatttgttcttcaccccctttgggagggggagtctaaataacagacacaggaaagggtctcacctcagcccacgctccttaagcaggccttgcttgtttttgttgttttgttttgagacagagtctcactctgtcacccaggctggagtgcagtggcttaatcttagctcccggcaacctctgcctccctggttcaagcaattctcctccctcagcctcccgagtagctacaggcgcatgccaacatgcccagctacttttttgtatttttagtagagatggagtttcaccatgctggccaggctggtctcaaactcctgacctcatgatccacccaccttggcctcccaaagtgctgggattacaggcatgagccactgcgcctagccccaccttgctgttttttaagttggaggagaaggctcccacctccctgaacctcaccctgtgtcctttgcagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattggggtgaggctttctccctggaattctggtccttttgggggcaaaaagggatagatccatgggaggaggcttctttctccactggtaccttgtttagtccattcctaccctaagcccatcccagtctcccatgtcatcccagacacccacgtcatttccctgggtgggaggctccctaactaggtccccaggctgagccactcatttcctccagtaccccggaacgcactgccctcagatctgctggagaatgtgctgtgtggcgtggcctttggcctgggtgtgctgggcatcatcgtgggcattgttctcatcatctacttccggaagccttgctcaggtggtatgtcatctggagggggcgggtgagcctgtgggagccagatacagtggtgcatgcgtgcatgtgtcaggattattttgtggcatggggggacatatagcgatcctcaggcccttgggtgtgggggcctgtatccagcaccatgggggcacatcttcccagttggggacccagttacacacacacagttatgggtcacaagaattgctttgagtgaaaaaaggaatcatggggtgctgtaggaagggtgcttggagatgatttgggaacaaggagagatcaacttctgcagggtgtggtgcaggcagggcgagcaaggcctttgtgggggaggaggaggaggagaaggaggaggaggatggatcccctgatgcctttcctccatccctgtctctcccccagactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcattt

SEQ ID NO: 1090 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 1091 - DNA, 338 bp, Homo sapiens
atgtatggaaaaataatctttgtattactattgtcagaaattgtgagcatatcagcatggagtacctctggtgtggcaatgcacacttcaacctcctcttcggtcacaaagagttacatctcatcacagacaaatggagaaatgggacaacttgtccatcgtttcactgtaccaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattct

SEQ ID NO: 1092 - DNA, 2331 bp, Homo sapiens
cccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgt

SEQ ID NO: 1093 - DNA, 1919 bp, Homo sapiens
gtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaactttgaagggcagatattactgcacaaactgccatctcgcttcatttttttaactatgcatttgagtacagactaatttttaaaatatgctaaactggaagattaaacagatgtggcccaaactgttctggatcaggaaagtcatactgttcactttcaagttggctgtcccccccgccgcccccccccacccccatatgtacagatgataatagggtgtggaatgtcgtcagtggcaaacatttcacagattattttgtttctgtcttcaacatttttgacactgtgctaatagttatattcagtacatgaaaagatactactgtgttgaaagccttttaggaaattttgacagtatttttgtacaaaacatttttttgaaaaaatacttgttaatttattctattttaatttgccaatgtcaataaaaagttaagaaataaaaaaaaaaaaaaaaaa

SEQ ID NO: 1094 - DNA, 3993 bp, Homo sapiens
ggcacgagcggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagtggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatwtcagtcatggaaggrtcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttgtcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaaaaaaaaaaaaact

SEQ ID NO: 1095 - DNA, 1767 bp, Homo sapiens
acttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtggacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcattt

SEQ ID NO: 1096 - DNA, 1541 bp, Homo sapiens
ccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaaaaaaaaaaaaaaaaaaa

SEQ ID NO: 1097 - DNA, 1795 bp, Homo sapiens
ccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaaaaa

SEQ ID NO: 1098 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 1099 - DNA, 725 bp, Homo sapiens
  misc_feature 624, 662, 668, 681: n = A,T,C or G
gccgcttttttttttttcttgaacaggatttttaactcagacagtgtaaacatcatgacaattctggaatgtctgaagtttgagatagaagattgtctaagaaaagctgagattgtcttagctgtttgtggtatccgaattcctctggaacatgggcatcaggaaccaagcgatgccactgctactgggcagggtttttatattttacctaaacagagacaaatgacgctgacctaccttaatgaaatttcagaaaaaccatctggaatcagccccatcatgtccagattggaaggtatctggggatcaatgaaacataccagaaatacttttcttcccccaaaccaatgtaatgaatgtcaaagtattgatgctaatttagattgtgattacatattaagttttgcttcattaattgtagcactggcagctgttttgtgaacgctgcatattaaactgtaggcagctgacaacaaatatcagcggaaggggatatttaaaagccagttaaattaatcaatgttttttaggaaactgagccaagattaaccccctggtgcttttacccacagaccctcgccaaagtctcccacaaggaacatttgtaggctattttgttttganatgttaaccccatctccgatgccttgctgacattttanattatntttaccagccctntaatgaatagcattccccaaaatttatgaagcaaaaaaaaaaaa

SEQ ID NO: 1100 - DNA, 580 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcc

SEQ ID NO: 1101 - DNA, 534 bp, Homo sapiens
tttgcaaactttcttatcttttagaatttgtaatatttgttcataaataggcacaaaataatttaaaaagccaaactgcattgggtaaatttacaagcctttgccttcttcaactcatgccacccacgcaacatttagttttactatatattacagctttctttacagcagaaaactttgaagtcttgttaaagggcaatacttgtgggtccccttaagatgtgtctctgtgtgtgtgtgtgtgtgtgtatgtgtgtgtgtgttacatttgtctgaactgcaacaaccaagcatggccaaacatttcccattatacattatagcaatctttcttctgaacaacaaactgatttttaaactgagaataaaaagtttataccactgtattgtgtgtagtccatgttctaaatccaggatgccccggagccaaaatgccctttcaggttctgcctgcaggttaggaaatagcaacagtttttgtttgtttgtttgttttctttagggatcaagggggctaggagggttacagaaatg

SEQ ID NO: 1102 - DNA, 971 bp, Homo sapiens
cactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 1103 - DNA, 2123 bp, Homo sapiens
agagagagggacgcgagcgggatccaaacttccggtgcctgcagagctcggagcggcggaggcagagaccgaggctgcaccggcagaggctgcggggcggacgcgcgggccggcgcagccatggtgaagattagcttccagcccgccgtggctggcatcaagggcgacaaggctgacaaggcgtcggcgtcggcccctgcgccggcctcggccaccgagatcctgctgacgccggctagggaggagcagcccccacaacatcgatccaagagggggggctcagtgggcggcgtgtgctacctgtcgatgggcatggtcgtgctgctcatgggcctcgtgttcgcctctgtctacatctacagatacttcttccttgcgcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcggggtctgactgcgtaccatgatatctccctggacaagtgctatgtcatcgaactcaacaccaccattgtgctgccccctcgcaacttctgggagctcctcatgaacgtgaagagggggacctacctgccgcagacgtacatcatccaggaggagatggtggtcacggagcatgtcagtgacaaggaggccctggggtccttcatctaccacctgtgcaacgggaaagacacctaccggctccggcgccgggcaacgcggaggcggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaaaaaaaaaaaaaaaaaaaaaaaaaaaaaaaaaaaaaaaaaaaaaaaaaaa

SEQ ID NO: 1104 - DNA, 557 bp, Homo sapiens
tttttttggagttgaaagatgtgagacagtattcagaataatgaagataataataatgattattataataatgatgatgattccaaggaaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagcttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccgaatgcagatctgaattataagatgtttatgtttgaccat

SEQ ID NO: 1105 - DNA, 962 bp, Homo sapiens
cctcccgtgtaaataaaaagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcaggaaggcatatgtttgtatttcaggctgatgcacctaatccaggactcattccagatgcagatgcagtaggcgtaactgttgtgctaattacttgtacctatcgaggacaagaatttattagagttggctattatgtaaataatgaatatactgagacagaattaagggaaaatccaccagtaaaaccagacttttctaagcttcaaaggaatattttggcatctaatcccagggtcacaagattccacattaattgggaagataacacagaaaaactggaagatgcagagagcagtaatccaaatctacagtcacttctttcaacagatgcattaccttcagcatcaaagggatggtccacatcagaaaactcactaaatgtcatgttagaatcccacatggactgcatgtgaccacctaccatccctttagtacaaattaagctattaaaaatacacagaactatttccctgaaattccgtaagtacatagtcaaaacacaatgtgaagaatttgtttaaaaacatcctgtagaaagtttataagaaaaccagtatttgaacaaattgtggaatataaatacaactatttttaagt

SEQ ID NO: 1106 - DNA, 2187 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccagcaagcacccatttgtggacagcaatcttctctaccagttcagaatgaacttccggcggaggcgaagactgatggagctgctcaatgaaaagtccccctcctcccaggaaactcatgacagtcccttctgcctggggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaaaaaaaaaaaaaaaaaaaa

SEQ ID NO: 1107 - DNA, 3447 bp, Homo sapiens
ggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaaaaaaaaaa

SEQ ID NO: 1108 - DNA, 1959 bp, Homo sapiens
cgaaaaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatggcgatgctgttgagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgacccaaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagccttcggctggaagtccatgggccaccctgttcttgtccatggaggacttccgagggttccaagtatactct

SEQ ID NO: 1109 - DNA, 2469 bp, Homo sapiens
ttcggcacgagtgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctctgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttggaatgggtgggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactccaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttgcccatgcttggttgttgcagttcagacaaatgtgacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggccaaggcttgtaaatttacccaatgcagtttggctttttaaattattttgtgcctatttatgaataaatattaccaattctaaaagataagtgtgtttcccacaaaaaaaaaaaaaaaa

SEQ ID NO: 1110 - DNA, 597 bp, Homo sapiens
ggtaaaataagttcagataaaatagtggtggtatttaaaataatattgctgaagtgcagattgaaatactttttaaacaactgaagttctgagtttttatagggaatttcatgtaacaagactggtttagaaacgtaaagttgcgcagtcaacataaataaatacagaatgccatgttctccacttctaagtaaagacagtgggcagcttctgtttctccttctatcaaggcttcaccctatcttaaaggtctgtggtgcctcccacgtgggacctgtctgctggtatgtgttaaacagcagaccggcccttctaccagatcttgatgcctctgattttctcctgcctacaagaaaatacaggcaaggttagtcaggtctggctatatttccactgttgtttcatttaataagatggcatctcctcttgagatatgttcttcttaccttttaagaagatactatttaagaagtgaactattcagtctttgtatactgaatgctttttccctaaaaaatgttaatcaagaatattgaatatttatggcactcttgatgctgcattttgaaagctgaaggaattactttagatagatag

SEQ ID NO: 1111 - DNA, 1701 bp, Homo sapiens
cggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattgaaaaataaaaaaaaaaaaaaaaaa

SEQ ID NO: 1112 - DNA, 3423 bp, Homo sapiens
gttttagccaaacaaatgggtttcggggcgagcgttgggcgccgccgcgccgcgctgggtgctcggtccgactcagcggtggggagcgagccaggcctcccgccaccgctgctgccgccaccactgcgtcgggctggtgcagccccgggccaggccgcggccggggcaggagcgcaggggctttgttatgcacctaaagccatattggaagctccagaagaaagagcaccccccggaagtcagcagggaaacgcagagaactcctatgaaccaccaaaaggctgtaaatgatgaaacatgcaaagctagccacataacatcaagtgtctttccttcagcctctctcggtaaagcatcatctcgaaagccatttgggatcctttctccaaatgttctgtgcagtatgagtgggaagagtcctgtagagagcagcttgaatgttaaaaccaaaaagaatgcaccatctgcaacgatccaccagggcgaagaagaaggaccacttgatatctgggctgttgtgaaacctggaaataccaaggaaaaaattgcattctttgcatcccaccagtgtagtaacaggataggatctatgaaaataaaaagttcctgggatattgatgggagagctactaagagaaggaaaaaatcaggggatcttaaaaaagccaaggtacaggtggaaaggatgagggaggttaacagcaggtgctaccaacctgagccttttgcatgtggcattgagcactgttctgtgcactatgtgagtgacagtggggatggagtctatgctgggaggcctctgtcagttatacagatggttgccttcttggagcaaagagccagtgctctgctagctagctgttcaaaaaactgcacaaactcacctgcaattgtgaggttttctggccaatccagaggtgtgcctgcagtgtctgagtcctattctgccccaggagcttgtgaagaacccacagaaaggggaaatcttgaggttggtgaaccacagagcgaaccagtccgtgtccttgacatggtagccaagttggagtctgagtgcctgaagcggcagggccagcgtgagcctgggagcctctcaaggaataacagcttccgtcgaaatgtgggcagagtattgcttgcaaatagcactcaggctgatgaaggcaaaacaaagaaaggcgtcttggaggcacctgacactcaggtgaatcctgtggggtctgtatctgtggattgtggcccttcaagagctgatcgttgttctcctaaggaggaccaggcctgggacggtgcttctcaggactgccccccattgccagcaggagtgagtttccacatagacagtgcagagttagagccgggttcgcaaactgccgtgaaaaacagcaacagatatgatgtggaaatgacagatgaactcgttgggttacctttttcctctcatacctattcccaagcctctgaattgcccacagatgctgttgattgtatgagcagagagcttgtgtcccttactagccgaaatcctgatcaaagaaaagaatctttgtgcattagtatcactgtgtccaaggtagacaaagaccagccttccattttaaactcctgtgaagacccagttccagggatgttgttttttttgccacctggtcagcacttgtcagactattcccagttgaatgaaagcacaacaaaagagtcttcagaggccagccagcttgaagatgctgctgggggtgacagtgcatctgaggaaaaaagtgggtctgctgagccatttgtactgccagcctcttctgtggaaagtacattaccagtgcttgaggcatccagttggaagaagcaggtgtcgcatgacttcctggagaccaggtttaaaatccagcagcttttggagcctcagcagtacatggcttttctgccccaccacattatggtaaaaatcttcaggttacttcccaccaagagtttagtggcccttaaatgtacctgctgctatttcaagtttatcattgagtactacaatatcaggccagcagattctcgctgggttcgagatccacgctatagagaggatccttgcaaacagtgcaagaaaaagtatgtgaaaggggatgtgtccctgtgccgatggcaccccaagccctattgccaggcattgccctatgggccagggtattggatgtgctgccaccggtctcagaaaggattccctggctgtaagctggggcttcatgacaatcactgggttcctgcctgccacagctttaatcgggcaatccataagaaagcaaaagggactgaagctgaagaggaatactaaagtccatgtgagaggcaacaaaaggaccggtttctaaagctgcaaaacacctagatacaccgttcaaatgagcgtagccccctgagtcatcactctagaagaatctgtacatcatcaggactgcattgctcaggcattttctaaactctaaatttacgagctgtacaaaaaaattggtcttgttgtttatagtggcatctcatgtttgaacccgggtggtatcccacagttggattcagttggctgtgaataactgcctgttttcctaaatcaaacccatcctcaaaggatgaagactcaccaccatccaggacattcagaagagttcactgcagatgctgcaggtagtcctcaaaaatgggttccagaaatgttttgagcactggcaacatatttgaaataagtgaatattgtcctgtgaaaagaatagcaggacttttagatgaaaagtattcttaaaaagaaaagtcaggcaccccaccttagacctcgtatgcttgatcctgtgagattgatgtttgtggctggaggtggatttcatgccctgtggtgtttacagtgtatataatggttgtgttttcatggggctatgaaagtgcacgttaaacctgagcgcctttacctttagatgagtgctttggcccctctgtgaatagcacgattaaaatccagttgtatataatggacagctaacggaacaatataatcaccacaatgcagctaggatagtgttgcggctataattttgtgtttttttttttaattgtctagtcttaaatttgtacatcttgtataaaatatgaatgtttcccaaataaactatgaatgtttcctgtataatatatgaatgtttctgagaagaaactctaaatagttgaaaggctaacctgctcaaaggataccaaataatggtttaactggacaacctgaaaattagcatagaaaacaatcctttgttatattttagtgatccacaagattgagaaaatattatatagttagataataacattcttgtctactttatcctgtctggttacaaaattttttaaaacttaaataaaaacatgcatcttaaatggaaaaaaaaaaaaaaaaaa

SEQ ID NO: 1113 - DNA, 1905 bp, Homo sapiens
gctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggaatggaagttggatacactttgtgacttgtacgagacactgaccattacacaggctgttatttttctcaatacgaggcgcaaggtggactggctgactgagaagatgcatgccagagacttcacagtttctgctctgcatggtgacatggaccagaaggagagagatgttatcatgagggaattccggtcagggtcaagtcgtgttctgatcactactgacttgttggctcgcgggattgatgtgcaacaagtgtctttggttataaattatgatctacctaccaatcgtgaaaactatattcacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaaaaaaaaaaaaaaa

SEQ ID NO: 1114 - DNA, 1527 bp, Homo sapiens
tctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcggcgctactacaatcagagcgaggccgggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatgggaggggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtcagagaaacagtccacctctgtgtctaccatgacccccttcctcacatgacctgtgttccttccctgttctcttttctattaaaaataagaacctgggcagagtgcggcagtcatgcctgtaatcccagcattagggaggccgaggagggcagatcagaggtcaggagatcgaaaccatcctgctaagaggtgaaccgtctctactaaaaatacaaaaattagctggcgcagaggcaggctgtgatccagctactcaggagcgagcagagatggcgtcaccggagcgagtgcggtgagcaggctgtgcg

SEQ ID NO: 1115 - DNA, 553 bp, Homo sapiens
  misc_feature 498: n = A,T,C or G
agggggttaaatgtttattaaatcaagcttttaaattatatatccacctacagtctataaacaaatatagtacacatgtatgtaaaaggctagcagataagaaccagtggaaaaactaaagttccctttgcacaccggcacctcatcacaacaccctcttggtgtggatgccatggggccatgctgtagtcaaaagttaaatgaaaaaccacaagtttagtttgactccgtctcctagggtggatttcattcagatatttgttccatattataggagggtggatcctagcaaggcaacagtgtagtttttacattcacagattggctgaagtagtacaaattgagctgctaatctaggtgtctccctccctgttaccatacttcataagaaatgtgaattaaaatgaacaatggaccacaggtggttataaaaatagataactcgcagagtccataaatatctacagttagtagagccagaacttccaaaatttaccntttttccataatggtgcagaatatccccaagtatggttccaagaggacacagtca

SEQ ID NO: 1116 - DNA, 8283 bp, Homo sapiens
gcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagacccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagcctcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagagggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttagatggatcaacttggatctttagacctcatctataaattgaaattatatttttagtcataagccaagtacaatctaactcagaatgggattaaaaattttagaagcagaagctaatatataaatgaagtttgggattcggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaagg

SEQ ID NO: 1117 - DNA, 664 bp, Homo sapiens
ttttctgcagaatccttaaaacctgtggcacttaaaatttgttagcctttctaatgagaggtaaattatacacaacaatgatgaaaaagattaacagaccagttgtctattatgaatcattccagctttgttcaacaatggccgaaactcttttctcatattctcgtttgttttcctgataaagctgtgctgcctggctattggctggactgttaggattcggttcatccagcagagactgaattgatgttaagatagaagatacatcatatgttggactccatcgattctgaaggatatctaaacatatgctaccatcagcatacacatttggatgaaacattttggataaaaacctaacagttggtggtttatttggatattcttcagaaaattctattactagtttaaaagtaccatcttcaaaaggtgtcccttctggtccaaatataactgcattccactgcatgatgttgttttcagatggtgcgccactgacacccacaggtgggtcctcttgtaaccgcttgaaaatccgcatgagcctcctccggggccgggtcgacatgctccgagctgcccgcggtcagtctgaaaaaaaaaagtcccgcgcagcccccaacccccggcgccggggcgaaataatgtggaatgccgcgccgcc

SEQ ID NO: 1118 - DNA, 564 bp, Homo sapiens
  misc_feature 564: n = A,T,C or G
ttttttttgggtgggggttctcatttattgtattgaggtcacaggtcaagtcattcactagtccccactaggaggggtggcagggacagggctgggggtggtggggcgagtcaccaaggtggggggcccagggagggcaagctcctttacccatctttgaaggctgttggggcctgggaatgtggaccagccccgcctgggccccagagcagggcacgaagccccacaaaggtcctgccgccacagaggagggcaacagagcccacaggcagcccagaggggcgggtggacggcactgcaggggctggcttcatgccttcttgaggttctggggcaagagaaagaccagattagaaagctggggacagctggacatggtgatgtttgcctgtagtcccggctgcttgggaggctgaggtgggaggatcatttgaggccaggagttgaccagcctggagaccttgtctattttctcttattattattattttttttttttgagagtctcactctgtagcccaggctggagagtgcagtagcatgatcttggctcactccaacctn

SEQ ID NO: 1119 - DNA, 723 bp, Homo sapiens
ggagagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttgagcaaaaatgaggagaaggcatataacagaaactcaagagacccaggaaagagacactttgaacaaagaccatggaaatgataaggaatcaaatgttctgcatcagtaattttaataaagaaaagcatgctctgagagaaagctgaaaaaaaaaaaagagaaaaaaaaaaaaaaagattgggggagccaccaggaacactagaaaaagctatagcgaaacaaaacgaggaacacaggaacacaaaaagagaagaaaaaggagacaaagagagaacagagaaaatcagggacaaaaatagggacagaaaaacacacaaaaaaaaagagcaccagaggaaaacacagagcgaggaagaaaaacaaaagggagaaaaggagaatacaaggaaacacacaaaggaatcaaagacaaggcaaaacaaataccca

SEQ ID NO: 1120 - DNA, 4286 bp, Homo sapiens
gagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcagaaaaaaaaaaaaaaaaaa

SEQ ID NO: 1121 - DNA, 537 bp, Homo sapiens
cttttttttttttttttaaaagggagagtgaggctttttattgtgtatgaattcacgtggtatcgacaactccacacaatattaaaacactgcgagaaagtgggtgcggcacacctggaattttaaaaaagtcagaaataaaaacaaccagacatcccaatgcagatggcatagaacctgctagaaccacaggcggcggctggaaacaggagacaggtctttacgaaggttagatgggcagcggttccgtggacagaggaggaggcgcggctggccggcatatggcttctgtgcagagggcctggcctcaggccgtggactttttaataagtgaccccttgaggaagggcgtggtggctccacctccacccggaagcccccccgggtcactcacgggcggacaggtgtgtgacggccctctcctacctgccccagaacttgggcaggacgggctgttaacttggagatggatgcgtggcctggaggcctagcgttgcgcctcggacacggtggccggcccgtcaaagggaccacgca

SEQ ID NO: 1122 - DNA, 2774 bp, Homo sapiens
cagcggcctttgcggttccaacatggcggagctgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatgcacataaagattttaagaaagcagtaggagcatgcagaattttttaccatccagaaacaacacagctaatgatactgtctgccagtgaagcaactgtgaagagagtaaacatcttaagtgacatgcatttgcgaagtattcgtacgaagttgatgcttatgtccagaaatgaagaggccactaagcatttagaatgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagagagtgctgatgctgtaaaaaaggctagaggtttcttggaatttgtggaggattttattcaggttcctaggaatctcgttggaaaagtaattggaaaaaatggcaaagttattcaagaaatagtggacaaatctggtgtggttcgagtgagaattgaaggggacaatgaaaataaattacccagagaagacggtatggttccatttgtatttgttggcactaaagaaagcattggaaatgtgcaggttcttctagagtatcatattgcctatctaaaggaagtagaacagctaagaatggaacgcctacagattgatgaacagctgcgacagattggttctaggtcttatagcggaagaggcagaggtcgtcggggacctaattacacctccggttatggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctgtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctagtcacagttgcagattatatttctagagctgagtctcagagcagacaaagaaacctcccaagggaaactttggctaaaaacaagaaagaaatggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaaaaaaaaaaaaaaaaaa

SEQ ID NO: 1123 - DNA, 3846 bp, Homo sapiens
gcgcctgcgcgggaggccgcgtcacgtgacccaccgcggccccgccccgcgacgagctcccgccggtcacgtgacccgcctctgcgcgcccccgggcacgaccccggagtctccgcgggcggccagggcgcgcgtgcgcggaggtgagccgggccggggctgcggggcttccctgagcgcgggccgggtcggtggggcggtcggctgcccgcgccggcctctcagttgggaaagctgaggttgtcgccggggccgcgggtggaggtcggggatgaggcagcaggtaggacagtgacctcggtgacgcgaaggaccccggccacctctaggttctcctcgtccgcccgttgttcagcgagggaggctctgggcctgccgcagctgacggggaaactgaggcacggagcgggcctgtaggagctgtccaggccatctccaaccatgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgctgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcgtgtccacagccgggcaccgtccccactctacagcgtggagttctccgaggagcccttcggggtgatcgtgcaccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccaatggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcagaggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccaatagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggagaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgttagccgggcggagtgtgttagtctctccagagggaggctggttccccagggaagcagagcctgtgtgcgggcagcagctgtgtgcgggcctgggggttgcatgtgtcacctggagctgggcactaaccattccaagccgccgcatcgcttgtttccacctcctgggccggggctctggcccccaacgtgtctaggagagctttctccctagatcgcactgtgggccggggcctggagggctgctctgtgttaataagattgtaaggtttgccctcctcacctgttgccggcatgcgggtagtattagccacccccctccatctgttcccagcaccggagaagggggtgctcaggtggaggtgtggggtatgcacctgagctcctgcttcgcgcctgctgctctgccccaacgcgaccgcttcccggctgcccagagggctggatgcctgccggtccccgagcaagcctgggaactcaggaaaattcacaggacttgggagattctaaatcttaagtgcaattattttaataaaaggggcatttggaatc

SEQ ID NO: 1124 - DNA, 1307 bp, Homo sapiens
ggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgtaaaaaaaaaaaaaaaaaaa

SEQ ID NO: 1125 - DNA, 569 bp, Homo sapiens
ttttttgcaagatttaattcttcctttaatataaataaggcagcatgaaacaccaagagccccactgctttctgctttagaagcagctttggtgcagaaaagattcccgtttccccaccgagttctgttgtctctgtacacacaagaagccagaagatatttttttttcagtgaactttctcctggaagcaaaggagaagctatgggagatccaggcatggttttggcttctggaggctgttttttggttactggggtctcttcaaagcaaaacgggatcaggatgaagagggggaaaggcatgggccataaataaataaggaaatttgccccgattctacaaatgcatctgatggaatgaggagggtcaggctgtgagggattgggggtagctccaggctgctgttagggacacacttgagctggttcattccctggagtgccccgcaactgcgtctagggagaggcaggcccaagcacatgttcagtctaattccagctcacactggaaggcttcctataggtttggttgccctgatcacagccgagctgccccaccaggaattaac

SEQ ID NO: 1126 - DNA, 2505 bp, Homo sapiens
tttgggttagggagagtgctttcgtttgttttaaatgggagaaactggagcatgttgccaaggcagagagccagcagagaggggtgaatggaagaaggagcgagaagggggttactgacgaagccttatcctggaggagagaaggatggactccagagcccagctttggggactggccttgaataaaaggagggccactctacctcatcctggagggagcacgaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccaaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctggagcttggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataaacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttaaaaaaaaaaaaaa

SEQ ID NO: 1127 - DNA, 6158 bp, Homo sapiens
ctcaagtatgtgttaattagcaaaccaactgaatggtcagatgagctgaggcagaagttcctagaagggtttgatgcctttttggaattactaaaatgtatgcagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggtcccacacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttcttttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtagatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctgaccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctctacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 1128 - DNA, 4522 bp, Homo sapiens
acccggcttccccaccccttgtactctaaactctgcagagggcgagcgtgcggccacggaggcgccgaggaggagcgagcgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagtttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgcgatactaactcggactctctgcagtcactgaaggaaatcatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttgatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgtt

SEQ ID NO: 1129 - DNA, 575 bp, Homo sapiens
  misc_feature 511, 547, 549: n = A,T,C or G
agcagcacatcaattctgtttctgtaactgcttcatggcacagactctgctgtgttccagtagggctgcgggagaaggcactctgcagagttactagttgtgttccctaaccaaaggcaacagtgagatccagaagcagatcattgtcactgagatcgcaggccacgtcaatggccttaggtggatctcataagggaaaaaaaaaatccaatgttacagggaaggactctaaaaaagtggtaacttttttttttttgtaagccgacattatttgggattgctgtttccaaggggaaaaaccaatagtgtgtttcttccattcatggaaggaaatatgattttaatttgtatgactggcaaccaaacaatgggcagcctcccagttcttcagtccctgaaggacagaaaaaggaacgacttgcaacatcttccaactctgaaagtcagtttctcctcctgagtcttctaaagctaccattaatattctcttgcaggtttaaggtactaaggnaccacctggcttacacatgccaccagtggtttaaangngatttcccagattttggtaataaagc

SEQ ID NO: 1130 - DNA, 2985 bp, Homo sapiens
gcgggccgccagtgtggtggaattcggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcatttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagagaattccaccacactggcggcccgcgcttgat

SEQ ID NO: 1131 - DNA, 3062 bp, Homo sapiens
  misc_feature 2252: n = A,T,C or G
tgacgttcaagttcgcagggacgtcacgtccgcacttgaacttgcagctcaggggggcttttgccatttttttcatctctctctctctctctccctctatctctcttctctctctctctctccctctttttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggggctctaatccccacgcccgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctttaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccgtcccagcccccggtcaagtccaagtcatgcgagttctgcggcaagacgttgaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggttgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcnatgcccaacacggataacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttagaaaaaaaaaaaaaa

SEQ ID NO: 1132 - DNA, 3338 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaaaaaaaaaaaaaaaaa

SEQ ID NO: 1133 - DNA, 4435 bp, Homo sapiens
gtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgtcttctgcaattaaacacgatttttattca

SEQ ID NO: 1134 - DNA, 8113 bp, Homo sapiens
tggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctgtgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 1135 - DNA, 623 bp, Homo sapiens
ttgaagcattcaaataatttgcactatattatcctgccaaattaaaaaaatatactgtggcagcctgtcttttttttttccactaccaaaaaaggtacattgataccttttaagagaacaagcaacagttaaaaatacaagcttcaatataaatactatagtgcctaacactagatgaacatttaattcaaataccattctagaaatacagaaaaaagaccataaatgtattttagcataggaatcaacatgagtgtgcattttcctatatttaagtactatataatcttaaacctttccccaatgtatgttttttttttttacaacctgaagagcggtgtgtatccaaggcatagaatttccactaccatttttaaatggataacaagtcttgtaacaccaccaagacaatggaaccctaaaatgcagttcccccctaaacataatgaagtgttttttaaaaaaaatttttcttaacatttatatttaaaaaagttttgtacaaaaaaatccttgcactgtagaagcgaaagcaatcattcatttctatgttaagtgtattctgtttccattcacagcgcttgcaatgttgcgtccaagtaagtaagctcaatagtcaagta

SEQ ID NO: 1136 - DNA, 3356 bp, Homo sapiens
attaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcccggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcgccactgcattccagcctgggtgactgagcgagactctgtctcaaaaaaaaaaaaaaaaaaaaaaaaaaaaaaaagaaaaaaaaaaaaaaaaaa

SEQ ID NO: 1137 - DNA, 1313 bp, Homo sapiens
ggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaaaaaaaaaaaaaaaaaaaaaaaaaa

SEQ ID NO: 1138 - DNA, 2076 bp, Homo sapiens
ctccgcccctttaacctttagggtgcgcgggtgcagtatatctcgcgctctctcccctttccccctcccctttccccaccccgggcgctcaggttggtctggaccggaagcgaagatggcgacttctggcgcggcctcggcggagctggtgatcggctggtgcatattcggcctcttactactggctattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgttatattgttctgtgtgttcttctggatcccttttgtctacttctattatgaagaaaaggatgatgatgatactagtaaatgtactcaaattaaaacggcactcaagtatactttgggatttgttgtgatttgtgcactgcttcttttagttggtgcctttgttccattgaatgttcccaataacaaaaattctacagagtgggaaaaagtgaagtccctatttgaagaacttggaagtagtcatggtttagctgcattgtcattttctatcagttctctgaccttgattggaatgttggcagctataacttacacagcctatggcatgtctgcgttacctttaaatctgataaaaggcactagaagcgctgcttatgaacgtttggaaaacactgaagacattgaagaagtagaacaacacattcaaacgattaaatcaaaaagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaagatcgtctggggaatatttttcatcttagttgcattgctgtttgtaatttctctcttcttgtcaaatttagataaagctcttcattcagctggaatagattctggtttcataatttttggagctaacctgagtaatccactgaatatgcttttgcctttactacaaacagttttccctcttgattatattcttataacaattattattatgtactttatttttacttcaatggcaggaattcgaaatattggcatatggttcttttgggttagattatataaaatcagaagaggtagaaccaggccccaagcactcctttttctctgcatgatacttctgcttattgtccttcacactagctacatgatttatagtcttgctccccaatatgttatgtatggaagccaaaattacttaatagagactaatataacttctgataatcataaaggcaattcaaccctttctgtgccaaagagatgtgatgcagatgctcctgaagatcagtgtactgttacccggacatacctattccttcacaagttctggttcttcagtgctgcttactattttggtaactgggcctttcttggggtatttttgattggattaattgtatcctgttgtaaagggaagaaatcggttattgaaggagtagatgaagattcagacataagtgatgatgagccctctgtctattctgcttgacagccttctgtcttaaaggttttataatgctgactgaatatctgttatgcatttttaaagtattaaactaacattaggatttgctaactagctttcatcaaaaatgggagcatggctataagacaactatattttattatatgttttctgaagtaacattgtatcatagattaacattttaaattaccataatcatgctatgtaaatataagactactggctttgtgagggaatgtttgtgcaaaattttttcctctaatgtataatagtgttaaattgattaaaaatcttccagaattaaaaaaaaaaaaaaaaaaaaaataaaaaaaaaaaaaaaa

SEQ ID NO: 1139 - DNA, 735 bp, Homo sapiens
  misc_feature 708, 721: n = A,T,C or G
ttttttttttttttttacagaacacagagtatagttttttattacatagctggagtttcataaggagaagcacgaaacatcgatgaatatgtatgtataccttggatgcaattccttctttcctggggaggcaagcaaaagtgtatcaaagaggccaatttactccctgtggtcaggaacttgcccacagcctgactcaaagcaaggatgttctctcaggagaacactgtggcattttccccagagctgaagaaatatcttcacttaaataatcttgaagtttgtaataaaataaataaagtgaattacacaaaaaggactagagctccctttaaaaaggcagctggttgagtttatgcaagcagggtatacacaagctcatgccccaacaacaaccagaaaacaggttattattatttagccttcctattgtacttctagggcagcatttcaatataatttaaaaaaatccctcatacataatgtaagggtatattatatatgtacacacttttactcctcagttcaagctaacttctttagaagtaaagacagtaataacccaaagagttacacgtcttcccagtaaaatattctaattttttaaaggtgcatattataaagagcagcttggtttctgtcaatggggaacatgtcagtctcagcagcctcagaatcacagtcccatggatggttctggatttcttngccggttcctcangaaagggacccggg

SEQ ID NO: 1140 - DNA, 1038 bp, Homo sapiens
atgtacaaggactgcatcgagtccactggagactattttcttctctgtgacgccgaggggccatggggcatcattctggagtccctggccatacttggcatcgtggtcacaattctgctactcttagcatttctcttcctcatgcgaaagatccaagactgcagccagtggaatgtcctccccacccagctcctcttcctcctgagtgtcctggggctcttcggactcgcttttgccttcatcatcgagctcaatcaacaaactgcccccgtacgctactttctctttggggttctctttgctctctgtttctcatgcctcttagctcatgcctccaatctagtgaagctggttcggggttgtgtctccttctcctggacgacaattctgtgcattgctattggttgcagtctgttgcaaatcattattgccactgagtatgtgactctcatcatgaccagaggtatgatgtttgtgaatatgacaccctgccagctcaatgtggactttgttgtactcctggtctatgtcctcttcctgatggccctcacattcttcgtctccaaagccaccttctgtggcccgtgtgagaactggaagcagcatggaaggctcatctttatcactgtgctcttctccatcatcatctgggtggtgtggatctccatgctcctgagaggcaacccgcagttccagcgacagccccagtgggacgacccggtcgtctgcattgctctggtcaccaacgcatgggttttcctgctgctgtacatcgtccctgagctctgcattctctacagatcgtgtagacaggagtgccctttacaaggcaatgcctgccccgtcacagcctaccaacacagcttccaagtggagaaccaggagctctccagagcccgagacagtgatggagctgaggaggatgtagcattaacttcatatggtactcccattcagccgcagactgttgatcccacacaagagtgtttcatcccacaggctaaactaagcccccagcaagatgcaggaggagtataa

SEQ ID NO: 1141 - DNA, 904 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcc

SEQ ID NO: 1142 - DNA, 4003 bp, Homo sapiens
gagctccctctctggcaccaagctccctggggtgagttttctttttgaagagtccaggggaacaggtaagcagtggggaagcagggagtccatttcagggacaggaattcccggatgaaaagtgaaaggagagggacggggcccaagctgagggtttcttcctggtttctcggacagctcctggaccaagactcagggaacattgagacagagcgtttgtcacaggaggagcggggtcagggcgaagtcccagagccccaggcatggctctcagggtctcaggccccgaagcggtgcatgggctggggaggtgcagcattggggattccccatctccgcagagtttctcttctccctctcccagcctgcgacgggtccttcttcctggacactcacgacgcggacccagttctcactcccactgagtgtcgggtttctaggaagccaatcagcgtcgcgcggccccggttctaaagtccccacgcacccaccgggactcggagtctccccagacgccgacgatggggtcatggcgccccgaaccctcctcctgctgctctcggggaccctggccctggccgagacctgggcgggtgagtgcggggtcaggagggaaacggcctctgccgtgaggagcgaaaggtccacctggctggggcgcaggacccggggagccgcgccgggaggagggtcgggcgggtctcagcccctcctcgcccccaggctcccactccatgaggtatttcagcaccgccgtttcctggccgggccgcggggagcccagcttcattgccgtgggctacgtggacgacacgcagttcgtgcgggtcgacagtgacgccgtgagtctgaggatgaagacgcgggcgcggtgggtggagcaggaggggccggagtattgggacctacagacactgggcgccaaggcccaggcacagactgaccgagtgaacctgcggaccctgctccgctactacaaccagagcgaggcgggtgagtgaccccggcccggggcgcagatcacttactccccgctccatgcctcacggacggccctggtcccctgagtctccgggtccaagatcgaccccgaggctgcgggacctgcagagatcctcgacccgggagagccccaggcgcctttacctggtttcatcttcagttgaggccaaaatctccgcaggttgctaggggccgggccagggctcggtgggcggggctgaccgcgggaactgggccagggtatcacatcctccagggaatgtttggctgcgacctggggcccgacgggcgtctcctccgcgggtatgagcagtatgcctacgacggcaaggattacatcgccctgaacgaggacctgcgctcctggaccgccgcggataccgcggctcagattacccagcgcaagtatgaggcggccaatgtggctgagcaaaggagagcctacctggagggcacctgcatggagtggctccgcagacacctggagaacgggaaggagacgctgcagcgcgcgggtaccaggggccatggggagcctgctcgatctcctgtagatctcccgggctggcctcgcacaaggaggggaagaaaatggaaacaccaccagaatatcgccctccctcctgtcctgacggagaggaatcctcctgggtttccagatcctgtatcagagattgactctgagggcccaccctgctcttcctgggacaattaagggatgaagtctctgagggagtggaggggaagacaatccctggaagactgatccgcggtcccctttcaccccacagcaaccttgggcaccaggacttttcctcccgggccttgttctctgcctcacactcaatgtgtcggagtctgactccagctcctctgagtcccttggcctccactcagatcaggaccagaagtccctgctaccctgctcagagactagaactttccaaggaataggagattatcccaggcgcctgtgtccaggctggtgtctgggctctgtgctcccttccccaccccaggtgtcctattcatcaggatggtcacatgggcgctgctggggtgtcccatgaggaatgcaaagtgcctgagttttccgactcttcctttcagaccccccccaagacacacgtgacccacccccctctctgaacatgaggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctggagaggaacagagatacacatgccatgtgcagcacaaggggctgcccaagcccctcatcctgagatggggtaaggagagagatgggggcggccatgtctcttagggaaagcaggagcccctctggagacctttagcagggtcggggctgggtcctggaggtcagaaccctcacattcccctcctttcccagagccctctccccagcccaccatccccattgtgggtatcattgctggcctggttctccttggagctgtggtcactggagctgtggtcactgctgtgatgtggaggaagaagagctcaggtggggaaggggtgaggagtcgggtttgagttttcttgtcccactgggggtttcaagctccaggtagaaatgtgttctgcctggttaccgggaagcaccatccacattcatgggcctacccagcctgggccctgtgtgccagcacttactcttttgtaagcacctgtgacaatgaaggacagatttctcaccttgatgattgtagtgatggggatctgaccccagtaatcacaggtcaggggaaggtccctgctgaggacagaccttaggagggcagttggtccaggacccacatctgctttccttgtttttcctgatcctgcccttggtttgcagtcacacatttctggaaacttctcgaggttccaagactaggaggttcctctaggacctcatggccctgctaccttcctggcctctcacaggacgttttcttcccgcagatagaaaaggagggagctactctcaggctgcaagtaagtatgaaggaggctgatccctgagatccttgggatattgtggttgggagcccatgggggagctcacccaccccacaattcctcctctagccacatctcctgtgggatctgaccaggttctgtttttgttctaccccaggcagccaaagtgcccagggctctgatgtgtctctcacggcttgtaaaggtgagaccctggggaggctgatgtgtgtgggttgttggggtaacagtggatatagctgtgctatggggtttctttgacttggatgtattcagcacatgatgggctgttcaaggtgtgacccctcactgtgagtgatatgaatttgttcatgaatattttttctatagtgtgagacagctgccttgtgtgggactgagaggcaagatttgttcatgccttccctttgtgacttcaagaaccctgacttctctttctgcaaaggcatctgaatgtgtctgtgtccctataggcataatgtgaggtggtggggagaccagcccacacccgtgtccaccatgaccctgttccccacactgacctacattccttccccgatcacctttcctgttccagagaagtggtgctgggatgtctccatctctgtctcaacttcatggtgcactgagctgtaacttcttacttccctattaaaattagaatctgagtataaatttacttttttcaaattatttccatgacgggttgatgggttaattaaaggagaagattcctaaaatttgagagacaaaataaatggaagacatgagaaccttccagagtccacgtgtttcttgtgctgatttgttgcaggggaggagagtagatggggctgtgccgatgtgtgctcaggccaccatgggctttatgtggtcacagctcacctgggtcactt

SEQ ID NO: 1143 - DNA, 871 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtatttgttcatgccttccctttgtgacttcaagaaccctgacttctctttgtgcagagaccagcc

SEQ ID NO: 1144 - DNA, 1050 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagc

SEQ ID NO: 1145 - DNA, 1958 bp, Homo sapiens
agctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccgtgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcgtccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgtgagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaaaaaaa

SEQ ID NO: 1146 - DNA, 623 bp, Homo sapiens
tttttttttttttttacaataaattattcattctaaccttagcaaaggtacatggattctgtctaccaaatattaattttacagtgaccacaaaaggttatttggttgttacaaagactacaatttgaagatactagataggcaaaaattttgccattattaatatcgaccaaacacagaaaagacaacagatgtgtttctaaggcacgatttacatactaaattcccttgaaattcaatgcaatttcacttcgctcatgattttcaatcacaagacacctgtgacaaatgaggaacaaatccagaagagcccatctaatctcgtcttaagtggtcccttaaatacgttaaaagcccaccaatataggcatttacaaggcttttctaagacttccagctcctgaaaaaatcacaccttcacagtttcaaatcaaccacctaagttgctaaggggcagcgaaggatgctgatctgctgcgtatgcaagtctgactcccatctttcaagtgactaattcacttgataacacccacaccccaaacaaaacaaccctctgaaacaggctgtcttggccaccaggaggaagctggtaaagacatttcccctgcctgtgagatggcatc

SEQ ID NO: 1147 - DNA, 2457 bp, Homo sapiens
tgctggaggaggataacaagttttgtgcagattgccagtctaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaaggatttattcgagacaaatatgagaagaagaaatacatggaccgaagtctggacatcaatgcctttaggaaagaaaaagatgacaagtggaaaagagggagcgaaccagttccagaaaaaaaattggaacctgttgtttttgagaaggtgaaaatgccacagaaaaaagaagacccacagctacctcggaaaagctccccgaaatccacagcgcctgtcatggatttgttgggccttgatgctcctgtggcctgctccattgcaaatagtaagaccagcaataccctagagaaggatttagatctgttggcctctgttccatccccttcttcttccggttccagaaaggttgtaggttccatgccaactgcagggagtgccggctctgttcctgaaaatctgaacctgtttccggagccagggagcaaatcagaagaaataggcaagaaacagctctctaaagactccattctttcactgtatggatcccagacgcctcaaatgcctactcaagcaatgttcatggctcccgctcagatggcatatcccacagcctaccccagcttccccggggttacacctcctaacagcataatggggagcatgatgcctccaccagtaggcatggttgctcagccaggagcttctgggatggttgcccccatggccatgcctgcaggctatatgggtggcatgcaggcatcaatgatgggtgtgccgaatggaatgatgaccacccagcaggctggctacatggcaggcatggcagctatgccccagactgtgtatggggtccagccagctcagcagctgcaatggaaccttactcagatgacccagcagatggctgggatgaacttctatggagccaatggcatgatgaactatggacagtcaatgagtggcggaaatggacaggcagcaaatcagactctcagtcctcagatgtggaaataaaaacaaaacacctgtatggctgccattctcttcagccctcgctctcccctttccacagcctccacccctgacccccatcctcttttcctacctctctgtttggtttagaaattgctcaataagtcatttggggtttggcatcctgcccagccacttcccaaacatgaagacctctctgttgctttatgttgtacatgccccatagccatcccaacgtcctccccagtcctctcctggcaccagcaccttagaagttgttggcagaaggcacttaaactgtgggagaagtgtgcacacctttgagtcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaagactttatgaagatcccacacacagacacacatcccttcccgcctcccccctgccttcagtaggatctggctccgtggctggaggaccaacccctatagtgggaatgcagagcttaacgtgtactgcttgtgtgtgtgcgtgagtgtgtgtgtgtgtatgagtgtgtgttccgcctcccaccctctccccatctgctctgggtatttttgtttttgtttagttttaggtttacaacagagaggaattaatttatcagcagcctaaaactgttgtgtttttcttatggtttaaaaaacgccatgtcattgataactccctttctcccttcccttctcccggtctgctgatcactctttcatgcctgtgtatccagggtgctctgtttccccaccgttcccaggtgtacgaggcagagggccgggacagctttcctctcagtcattgttcaccccacttgaaaattcagacaagaaaactttgcttaaaagatttcatgtgtgggaaccacagttcctggctgcctttctcctgtgtatgtgtaaattccttaataaatattgcagggaaggac

SEQ ID NO: 1148 - DNA, 898 bp, Homo sapiens
ttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaatagaagcttccgtagtgcatggtatggattaaaatgcataaaatattcttagactcgatgctgtataacaatattatgggaccaaacagacatatgttatttgcctctaaacttttattgaagttcattggcaggcaaaacaacttgactctggtcacatttaaaccaaagtacaggggaaaaacaagtattggttggcatggttagccatctggtatctcgtaaatacggggtgcttgcattctcttacattgtcacggcatctaaatttaaaacggtcccaaatatccaactaataattctcaataacatttttcctgggggcacagtcagccactccaatttggagcgcattcagagtgactttgcccgagcgtcgccaaggtacgtacagaactgcaagctgaacatcacggtagatatcgcaaagtccacactttctatccct

SEQ ID NO: 1149 - DNA, 894 bp, Homo sapiens
  misc_feature 47, 271, 290, 333, 359, 466, 467, 582, 655, 669: n = A,T,C or G
gaggaagaatcatgatacacgttggattaagtatcttggactggttntaaacagtgctttgtaccggatctgctgaagcatctgtccagctggtatcctgtgaaagtttgttattttctgagtagacattcttatagagtattgtctttaaaatcagattgtctcttctatattgaaagcatttttatgttttctaatttaaaaattaatattttcttatagatattgtgcaataaagctgaagtagaatgtgtggttcttgcaaatgctntaacagctgataaaaattntacatttgtaaaattaatatattgtactggtacaaaatagttntaaattatatcttaaaaagcttacanaaaaaaaaaaaaaactcgagggggggcccggtacccaattcgccctatagtgagtcgtattacaattcactgggccgtcgtttacaacgtcgtgactgggaaaaccnnctgcgtacccaacttgaatcgcttgcagcacatgcgccttttcgcagctggcgtatagcgaagaggcccgtaccgatcgcctttccaaacagtgcgcacctgaatgcgaatgcanattgtagcgttatattttgtaaaatcccgtaaatcttgtaaatcactcattttgaccaatagccgaatcgcanaatcctataatcanagatgaccagataggttgaatgtgtccactggaccaggtcactataagacgtgactcacttaaagcggcttaagactaatcgaccctaaggaccccattaacttgcgggaagcgcaacgtgcagacgaggagaactacgtacgcctaggcctgaagttacgtaacttccttacacaaaccctcgtaagtctttaggtctaagggccttctggaattcctaactct

SEQ ID NO: 1150 - DNA, 618 bp, Homo sapiens
aaaacagaagtaatacaattttaatttcaatattttaaaatacagaaattggaaagaatactaaatacaactttaaacaagtcacttgtcctcccctataataatcaatgtaagctacttaaagacttacaaatttaaagtaaaacagaaacaaaataaatactgtacactttccctgcctgcaggcaaaagatgggaaatactgttatgaatcagcaaagaaatgctcttcaagcttcagcaccccacctcccagccacaccccacgccattgtcacacagtgggcttccggactgaaaggacacacatgtcacacacattgactgcctatacaaacaagacgagacgctattccgcagacacccccaacaagaagaacagtcccctcggaccgtgggcataaaaaccagtaagaaaagtcagtcaggctagcaaaacgttactacaaaactagtaaataccagagccaacaactgtcccctctccaaagttcacagatttgaaacctctaaaaccaatactacccctccccatcaccccccaaaaaaacttgctgaagcactggcaaagttagacatttcacagtaaatgtgaaagttcatattatataatctctt

SEQ ID NO: 1151 - DNA, 1464 bp, Homo sapiens
tggaaaacatgctgctcgggggacccccccgcagtccccgctcggggacgagccccaaggggccctggagcagtacaggccacgtgcagtttggcaagagcccccagacctggcccaggcgcacaagaccccgctctccagagcctgccgcgccttcaggggttcggggctccacttggacgaggcgccgtgactctccgaggcgcgccgggccgacagcgctgtcccgctacgtgggccacctctggatgggccggcggccgccctcccccgaggcccgcggcccagtcccccgcagttcagctgccagtcgggccagaagaagcctcgcctccccggggatctccccaggccccctgaccgcaacgatcggaggggcggtggcggggggcgggcccaggcaggggagggcagaagcacacaaggaagtgtttccgggacagagggtgggcaagatggcggcgcccatggagctgttctgctggtcagggggctgggggctgccgtcagtggacctggacagcctggccgtgctgacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgaaaaaaaaaaaaaaaaaaaaaaaa

SEQ ID NO: 1152 - DNA, 367 bp, Homo sapiens
caggtgcagctacagcagtggggcgcaggactgttgaagccttcggagaccctgtccctcacctgctctgtctatggtgggtccttcagtggttactactggagctggatccgccagcccccagggaagggactggagtggattggggaaatcaatcatagtggaagcaccaactacaacccgtccctcaagagtcgagtcaccatttcagtagacacgtccaagaaccagttctccctgaagctgagctctgtgaccgccgcggacacggctgtgtattactgtgcgagaggcaggtattatcatggttcggggagacaaccactttgactactggggccagggaaccctggtcaccgtctcctca

SEQ ID NO: 1153 - DNA, 396 bp, Homo sapiens
caggtgcagctgcaggagtcgggcccaggactggtgaagccttcggagaccctgtccctcacctgcagtgtctctggtggctccatcagtagttactactggagctggatccggcagcccccagggaagggactggagtggattgggtatatcaattacagtgggagcaccaactataacccctccctcaagagtcgagtcaccatatcagtagacacgtccaagaaccagttctccctgaagctgagctctgtgaccgctgcggacacggccgtgtattactgtgcgagaacgatttcggggggtcgattacgatttttggagtggacccgagggggaaattactactactacatggacgtctggggcaaagggaccacggtcaccgtctcctca

SEQ ID NO: 1154 - DNA, 327 bp, Homo sapiens
gaaattgtgttgacgcagtctccaggcaccctgtctttgtctccaggggaaagagccaccctctcctgcagggccagtcagagtattagcagcagtttcttagcctggtaccagcagaaagttggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtagctcgcctctcactttcggcggagggaccaaggtggagatcaaacga

SEQ ID NO: 1155 - DNA, 2113 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctccc

SEQ ID NO: 1156 - DNA, 2857 bp, Homo sapiens
gaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgcaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtacggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacagggtcagaagaatgatggaatgttttagaataaactcctgcttatagtatactacacagttcaaaagatgtttaaaatgctttgatttactgctggta

SEQ ID NO: 1157 - DNA, 10562 bp, Homo sapiens
cagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaaatgaggaaacatcggcacttgcccttagtggccgtcttttgcctctttctctcaggctttcctacaactcatgcccagcagcagcaagcagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtggtcattcattttactgatggagcagacggagatctggctgatttacacagagcatctgagaacctccgccaagaaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgacaacattgccgagaaagcttgctgtggggttccctgcaagtgctctgggcagaggggagaccgcgggcccatcggcagcatcgggccaaagggtattcctggagaagacggctaccgaggctatcctggtgatgagggtggacccggtgagcgtggtccgcctggtgtgaacggcactcaaggtttccagggctgcccgggccagagaggagtaaagggctctcggggattcccaggagagaagggcgaagtaggagaaattggactggatggtctggatggtgaagatggagacaaaggattgcctggttcttctggagagaaagggaatcctggaagaaggggtgataaaggacctcgaggagagaaaggagaaagaggagatgttgggattcgaggggacccgggtaacccaggacaagacagccaggagagaggacccaaaggagaaaccggtgacctcggccccatgggtgtcccagggagagatggagtacctggaggacctggagaaactgggaagaatggtggctttggccgaaggggaccccccggagctaagggcaacaagggcggtcctggccagccgggctttgagggagagcaggggaccagaggtgcacagggcccagctggtcctgctggtcctccagggctgataggagaacaaggcatttctggacctcggggaagcggaggtgccgctggtgctcctggagaacgaggcagaaccggtccactgggaagaaagggtgagcccggagagccaggaccaaaaggaggaatcgggaaccggggccctcgtggggagacgggagatgacgggagagacggagttggcagtgaaggacgcagaggcaaaaaaggagaaagaggattccctggatacccaggaccaaagggtaacccaggtgaacctgggctaaatggaacaacaggacccaaaggcatcagaggccgaaggggaaattcgggacctccagggatagttggacagaagggagaccctggctacccaggaccagctggtcccaagggcaacaggggcgactccatcgatcaatgtgccctcatccaaagcatcaaagataaatgcccttgctgttacgggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcagatcaataacacagcagtggggcatgcgcttgtcctgcctgcagggagagacctcacagacttcctggagaatgtcctcacgtgtcatgtttgcttggacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtgaaaatgctttttacttgtccccagatatcaggaaacagtgtgattggttccaaggggaccaacccacaaagaaccttgtgaagtttggtcacaaacaagtaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaaagaaatctcagcccccacctccacagccagcaaggtcagcttctagttcaaccatcaatctaatggtgagcacagaaccattggctctcactgaaacagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctgtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagttaaaaaaaaaaaaaaaaaa

SEQ ID NO: 1158 - DNA, 1696 bp, Homo sapiens
gcacgagggtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagaaaaaaaaaaaaaaaaaaaa

SEQ ID NO: 1159 - DNA, 332 bp, Homo sapiens
gacccagtctccatcctccctgtctgcatctgtaggagacagagtcaccatcacttgccaggcgagtcaggacattagtaattttttaacttggtatcagaagaagccagggaaagcccctaaagtcctgatctacgatgcatccaatttggaaacaggggtcccatcaaggttcagtggaagtggttctgggacagattttactttcaccatcgccagcctgcagcctgacgattttgcaacatattactgtcaacaatataatgatcaccccctcactttcggccctgggaccaaagtggatgtgagacgaactgtgccgcaccatctaa

SEQ ID NO: 1160 - DNA, 310 bp, Homo sapiens
ggggggtccctgagactctcctgtgcagcctctggattcacctttagtagcaattggatgagctgggtccgccaggctccagggaaggggctggagtgggtggccaacataaagcaagatgaaagtgagaaatactatgtagactctgtgaagggccgattcaccatctccagagacaacgccaagaactcactgtatctgcaaatgaacagcctgagagtcgaggacacggctgtgtattactgtgcgagagccgaccccgggtatagcagtgcctggggccagggaaccctggtcaccgtctccttag

SEQ ID NO: 1161 - DNA, 492 bp, Homo sapiens
ctaggctaggagcgcaagctcatgtttattcattcatttggtagcgctagaaactggcaactgtgggctaaatctagcccatagacctaaatttatgtttttcttaaccttcacaatatttagaaatcagagcacttcacataggtctacattttcagcttcttttagcaggaatgctccttcaaagggtatctgcattcctgttcccacagcccccagcattccttgtcctttagctgcctggcttctctaggcacctgagttcatggtcctgggttagaagctgcagaaaggactgtgctgactccctcaactaaggggtggtactaccgcttgctcctctcagcagctgacatcccagagatcagtttcctttctgggagggactcctcattgaggggggtgcagaagacctgcagacctgcatcaaccctggtctttgaggcttcaactcctgaaaatcaatcaattgagccctacctttaccagacc

SEQ ID NO: 1162 - DNA, 577 bp, Homo sapiens
ttttttttgaagccacgagttttttttaggcctggcctgtgggccaggagtcagggaaggggcttcctggagggctccctggaggaggtggggctcagggggggctggactcggaaatcaaagagcaggcgggcggtttgcgacgcccgggcggtcgcaggcggctcctggcgcagtgcggacccgggctgcttgcgggaggaagcggctgaagcccaggccggggtcagaggggagggcgcgtgcggggcggggtcgccgagagaaaaagaggcccccctcagccctgccaaacgcagtcctggcccggagcctgtccgtccaggccgacggcgtagcgcgaactccagtcccgctcaaagagctgccgcagctgctcctgcaccgtggcccccgcgggctgcgcgccagggctctgggtgaccaccaagcccacccccgccgtgctgctgaagtaatcctccgaccagttggaggtgcctatgtaggctgccttctccgtgaccatgaacttgctgtggttcaccctgctgaatgggatgttggaatggttccccaccggcacgatgaagacttt

SEQ ID NO: 1163 - DNA, 3745 bp, Homo sapiens
gaattcggcacgaggccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccacacccccggagccagaggaggagatcctgggatcagatgatgaggagcaagaggaccctgcggactactgcaaaggtggatatcatccagtgaaaattggagacctcttcaatggccggtatcatgttattagaaagcttggatgggggcacttctctactgtctggctgtgctgggatatgcaggggaaaagatttgttgcaatgaaagttgtaaaaagtgcccagcattatacggagacagccttggatgaaataaaattgctcaaatgtgttcgagaaagtgatcccagtgacccaaacaaagacatggtggtccagctcattgacgacttcaagatttcaggcatgaatgggatacatgtctgcatggtcttcgaagtacttggccaccatctcctcaagtggatcatcaaatccaactatcaaggcctcccagtacgttgtgtgaagagtatcattcgacaggtccttcaagggttagattacttacacagtaagtgcaagatcattcatactgacataaagccggaaaatatcttgatgtgtgtggatgatgcatatgtgagaagaatggcagctgagcctgagtggcagaaagcaggtgctcctcctccttcagggtctgcagtgagtacggctccacagcagaaacctataggaaaaatatctaaaaacaaaaagaaaaaactgaaaaagaaacagaagaggcaggctgagttattggagaagcgcctgcaggagatagaagaattggagcgagaagctgaaaggaaaataatagaagaaaacatcacctcagctgcaccttccaatgaccaggatggcgaatactgcccagaggtgaaactaaaaacaacaggattagaggaggcggctgaggcagagactgcaaaggacaatggtgaagctgaggaccaggaagagaaagaagatgctgagaaagaaaacattgaaaaagatgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaatgcagaaagtgattacacatatagcagctcctatgaacaattcaatggtgaattgccaaatggacgacataaaattcccgagtcacagttcccagagttttccacctcgttgttctctggatccttagaacctgtggcctgcggctctgtgctttctgagggatcaccacttactgagcaagaggagagcagtccatcccatgacagaagcagaacggtttcagcctccagtactggggatttgccaaaagcaaaaacccgggcagctgacttgttggtgaatcccctggatccgcggaatcgagataaaattagagtaaaaattgctgacctgggaaatgcttgttgggtgcataaacacttcacggaagacatccagacgcgtcagtaccgctccatagaggttttaataggagcggggtacagcacccctgcggacatctggagcacggcgtgtatggcatttgagctggcaacgggagattatttgtttgaaccacattctggggaagactattccagagacgaagaccacatagcccacatcatagagctgctaggcagtattccaaggcactttgctctatctggaaaatattctcgggaattcttcaatcgcagaggagaactgcgacacatcaccaagctgaagccctggagcctctttgatgtacttgtggaaaagtatggctggccccatgaagatgctgcacagtttacagatttcctgatcccgatgttagaaatggttccagaaaaacgagcctcagctggcgaatgtcggcatccttggttgaattcttagcaaattctaccaatattgcattctgagctagcaaatgttcccagtacattggacctaaacggtgactctcattctttaacaggattacaagtgagctggcttcatcctcagacctttattttgctttgaggtactgttgtttgacattttgctttttgtgcactgtgatcctggggaagggtagtcttttgtcttcagctaagtagtttactgaccattttcttctggaaacaataacatgtctctaagcattgtttcttgtgttgtgtgacattcaaatgtcatttttttgaatgaaaaatactttcccctttgtgttttggcaggttttgtaactatttatgaagaaatattttagctgagtactatataatttacaatcttaagaaattatcaagttggaaccaagaaatagcaaggaaatgtacaattttatcttctggcaaagggacatcattcctgtattatagtgtatgtaaatgcaccctgtaaatgttactttccattaaatatgggagggggactcaaatttcagaaaagctaccaagtcttgagtgctttgtagcctatgttgcatgtagcggactttaactgctccaaggagttgtgcaaacttttcattccataacagtcttttcacattggattttaaacaaagtggctctgggttataagatgtcattctctatatggcactttaaaggaagaaaagatatgtttctcattctaaaatatgcattataatttagcagtcccatttgtgattttgcatatttttaaaagtacttttaaagaagagcaatttccctttaaaaatgtgatggctcagtaccatgtcatgttgcctcctctgggcgctgtaagttaagctctacatagattaaattggagaaacgtgttaattgtgtggaatgaaaaaatacatatatttttggaaaagcatgatcatgcttgtctagaacacaaggtatggtatatacaatttgcagtgcagtgggcagaatacttctcacagctcaaagataacagtgatcacattcattccataggtagctttacgtgtggctacaacaaattttactagctttttcattgtctttccatgaaacgaagttgagaaaatgattttccctttgcaggttgcacacagttttgtttatgcatttccttaaaattaattgtagactccaggatacaaaccatagtaggcaatacaatttagaatgtaatatatagaggtatattagcctctttagaagtcagtggattgaatgtctttttattttaaattttacattcattaaggtgcctcgtttttgactttgtccattaacatttatccatatgcctttgcaataactagattgtgaaaagctaacaagtgttgtaacaataatccattgtttgaggtgcttgcagttgtcttaaaaattaaagtgttttggtttttttttttccagaaaaaaaaaaaaaaaaaaaaaaaaaaaaaattcctgc

SEQ ID NO: 1164 - DNA, 327 bp, Homo sapiens
gaaatagtgatgacgcagcttccagccaccctgtctgtgtctccaggggaaagagccaccctctcctgcagggccagtcagagtgttcgcagcaacttagcctggtaccagcaaaaacctggccaggctcccaggctcctcatctacggtgcatccaccagggccaatggtatcccagccaggttcagtggcagtgggtctgggacagagttcactctcaccatcagcggcctgcagtctgacgattttgcagtttattactgtcaacactataataactggcctccgtggacgttcggccaagggaccgaggtggaagtcaaacgt

SEQ ID NO: 1165 - DNA, 895 bp, Homo sapiens
  misc_feature 323, 515, 545, 617, 627, 648, 675, 760: n = A,T,C or G
gcggccgccgctcttggccccgcagacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggncgtggcggggtccaacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttganccgagtttgtttttcaaaatggtgcaatanattaagtggcatcttctctcccaccggtctacactagaggatcgaggcttgtgatgccttgtgagaaataanggccttaatntgtactgtctgcggcattttntataatattgtatatagtgactgacanatattgtattactggacatagagaggcagtgggcatttttggcctacctgggtcgtttatagattttgctgggtggtttttttanttaaagtttgatcttttctctgccgaatctggcctgaggcaaattcctatatggtgatttatcgtatatgccatagtgttctggtgaatgatcggtcaatccccccatcgagccgagccataggaggactgtgcc

SEQ ID NO: 1166 - DNA, 648 bp, Homo sapiens
aatattttaatagataatatattagtgtacatctgaatatacatttgccaaaatgttccattagtatgaagttggtctgaagtggaagtgaagtgcagtggtgtggcagggtaacatttaatggccgtcctgggcatcaggggacatggaatggctgagtcttgaccttccattcacagatattgtatttgatggaatggtaacccttttcaatttggcagcagcctctcccgaacggattgcagtcagcaaactctgtcgcatctgttctgggtcagagctttggaatgttaaagaactttgtctcataacagtgaatgatgggccatcagttggagttggtatttgggaattctgttcattatgtgcagagttattttccttatcagacacaccaagctgtgggatgtccacaaatttatttacagaatgagtcttcccttcctctgtgttggctggaggttggaccaatgcactggcactaggtgactcggtgcgctctttactgaaagactgtgaccttttcactacagcaagagcaaacggtgaaggaccagaacttgagtatggtcgtggggcaccaaaaagtttcaaagtcttcagattttgtgtggatacctgactagcacgaaaagtcacagggtttgg

SEQ ID NO: 1167 - DNA, 5026 bp, Homo sapiens
agaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatacttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttc

SEQ ID NO: 1168 - DNA, 651 bp, Homo sapiens
attgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagca

SEQ ID NO: 1169 - DNA, 971 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatgtaagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaagccaa

SEQ ID NO: 1170 - DNA, 963 bp, Homo sapiens
ggatgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccwtctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtacagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcacaccaagaatttgtggcytccttgtgagggagagaactgagcatctcagcattctcagcacamccaa

SEQ ID NO: 1171 - DNA, 610 bp, Homo sapiens
  misc_feature 318, 447, 484, 526, 540, 560, 581, 598: n = A,T,C or G
aatcttttattttttattgcatacatcaatatttaacagaagaaaaataaagaacccctaatgttaaactgaattacatgttatcttctgattcttttcaatgtagacctaaattttcacatgtatcagtaaacacaatttatgttcttattaacatttttgaatctcacttttttgcatacaatttgacatatatcaatattattgaatggctatataacattctgtgatagcactagcaatacaccaaaatttacttaaccatttccaatcgttgggcttttttcccccttaaagttatctgagtggaactgctanaaaactttgtacaaatagcttttctttcttttaaatattttcctgggcatatgccactcaaagtgagtatgtcaaaagatcagttataaagccctttttatagtcttctacacagttctcttaaaaggntactaatacacaatgctgctgctataaggaccatgcnattaaaacagtttggctaatacaatacatgaactaattcaanttggctttttaatnttaggaaatttgaatacctnccaatgaattttaaacccttnaccccaaacctttaaanttgccaaaaata

SEQ ID NO: 1172 - DNA, 584 bp, Homo sapiens
  misc_feature 407, 424, 527: n = A,T,C or G
tccagatcagcacaaagtttattagccatttctgctcagaagagcccctttctgaacaggactgttcctctgacataacagacaagaaacagccacctgtgcagggcctttcctttatatctcaagctacatcaggagaacatcttggagcaatgtcagttgccccctgggttccctgggaatagctaaggtgtgagattgtccagagtcctatgacagaccttcaaggttttaagttccacagacttggactttgtcaggtccacaaccaacgaatagaaaccttcctttcaggtaaacaacatattgtacaaaaaagggaggattgataacataatagagaaagagctaagacccatttgcttctcctctgtaaaaacaccaaactttatccaatactataaaanagaaattcctgctgggnacagtgggctcacgcctggtaatcccagcactctggggaggccgaggtggacagatcacttgaggtcaggagttcgagaccaggcctgaccaacatggagaancccgtctctactaaaaattcaaaattagctgggcatggtggtgcagattgtaatccc

SEQ ID NO: 1173 - DNA, 1063 bp, Homo sapiens
ggctggtaccggtccggaattcccgggatccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggccgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccatagggctccgaccaggccatcatcacgctccgsttctgcascaccttggccgccctctggcccttcctgggcatcgtggctgaggtgctggtgctkgtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccgcgtctgcgccgccgccggagtccactcccagtgcttgcaagattccaagttctcacctcttaaagaaacccaccccgtrgattccatcatacacttcttcttttttaaaaagttgggtttctcattcaggatttgttcttaggatttttcttytgagtktttasaracccggg

SEQ ID NO: 1174 - DNA, 735 bp, Homo sapiens
  misc_feature 619: n = A,T,C or G
agaacaatatttatttccatttacagcatcaaataccataaataaagctaaacatggttggtttggctgtgtgcaaaatacagggttccgtgtggcactgtaaatgattaccaaaggtcacagacttgcgttgtgatgagatggggaggctagctaaagaggaggctgagaggggaggagggcactcttgggttgacattctataaagggagggagactctgtaagagaagataagacaagagcaacgacttggtacgggccaggatctgcacaaatacagtgagcgtgcagcatgcagggccaggcaggcaggcccgggggtcagggtggtctgggccacatgcaggacagacgcccaccgcagcctgagaccgcgaggtgttgcctaggacagctccactggtgctgggggtgtggtttctccgtaagagtgtgtgggtgattatcctgctgccccaggtacaagagtcagcagaaatgtgtgctttaagcagagtcacaggggccgtggggctgaacgtgagtcatttctcaaagatttccctgctgggatgatgatggtctaatggaagctctggcatcatcgggggctttatgagccagggagataagaagagncacagaaaaccctgggtctacagggcaggctgcaaccaaggcagcttggctagcaatttcgggatcttgttgtcaacctacagagcatgtgtcaagctgggatgaggccgagagta

SEQ ID NO: 1175 - DNA, 92558 bp, Homo sapiens
gatccacccacctcagcctcccaaagtgctgggattacaggtgtaagccaccgcacctggctaaccattttttatgaattagacggaagcactttaagggcagaggccacatttatatttcttatgaatgcctggcacagtggcaggagcactgtggtctcataatatactcttgctgattgaacaaaggactttcgtctgtagggaacattaaacagcttaatgttaacacatctacctgagccaagcaccagggtcaactagagagcaaaccagagctgtgaggaggatgggagggaggaaacccatgagacagcactgagaactgagagagaacaatgacccagtagtgcaggggacaatgagggctcagagctggttgtccttgtgacagagggagttgtattagttgaatgaatgaatgaaggcaggaactctagtaggactaaatctattagtcaaggttgttttccaaagactgtcactgccctagagcaaagggagggtgattgtgatgtggttatatgtgaaaatacactaattgccattatcatggaaaggaacaatattttagtaataggacaatcctctctgttcatcattctaaagacaacagtacttaatactgggtcaagttccaaatggatagtattatactatggcataatggcggatctgtaggagaagtagctggcatagatggacaaagtgaatgtaattacagagcctagaacccagtaaatacagaaggggatgaaggtatagaagtgatcagatacattcaagagggcataagtgagaggaggaagtacttccttcccaccacggggttgcttttattttccacaatccaaggcattgatgagatcaaaaaagtttgacatgggttaaaccagagacaggcacagcaagtttgctattttatagcacatgcatacacgggtttgtatgtatattgtgaaatatttatgaatatatattccactgctcattctttatcctgccattgtactggtacacacctaatggccttcctcatacaattccttgaaatatcctagtgaacttaatagtaaaataaaccaaaattatacataagaaccaaacttgaggttgtcaactcaacaaatgcaaagagcattcagtatcagtcaagaatggcctttaaaatgaatgaaaagatttctgatatggacacatttagatgcttatgatcagcctaattaaagatttattcatgcccaccacagtgggtgacatctctaagacttagcataactgagtcattgtgtttggaccctctgttcttcagagcaccctccagcttgcagaaggcctgattgtgtgtttccattttggaactggcttaagaatgtgtaaggatacaagcagtgattacagtgatctttggtcaacgcacctgtgacctctgaaaatagatgaattgtgagaccatggtttgtcttcctaaaaactcagagtgttcaaaacattccagtgaaaaaaaggaatggcaagcatcattttcttactccacagatgggaaaactgaatcatggtggcagggggcggtagatgaattactcccaattccaccaagaaatgtgtcatagctattatagtgtccagctctactctccctttcaatccatatagctaaatcttttttttttttttttgtaagacagagtcttgctggtcgcccaggctggagtgaagtggcaccatcttagctcaatgcaacctccacctcccgggttcaagcaattctcatgcctcaggctcccaagtagctgggattacaggcctgcaccaccatgcccggctaatttttgtatttttagtagagacaggattttgccatgctggtcaagctggtctccaactcctggcctcaagtgattcacccgtctcagcctcccaaagtgctaggattacaggcgtgagccactgtgcccggcccatatagctaaatcttgatttgttgttttgatcctctcaagtctagattaatgctatttcccctcatagactccctttttctcatttagttggggtaattattatttccaaacttatgtggcagttccgttataatgggtcctttgttctgcagcccctacccactatggcaactccctctggcatcatctagaacacccaccacaacaaacttgtgtcttctctctgctcagttcttcctatcatcaattcatactcagatgcaagtatcgtgctcacactccagacctcgttctttgtttccactgtagtcatgctcctgtaaacactggccactcctcccatcagccaagctttatcctctccctcactgctaactcctctttaatcatatacttccacagaggacatgcacactaatgaaatgaggggaaggaagattccgattccccacatatccctttaagcagcttctctttttatgggccctacttcaggctcaaaacaagcaagggaaaatggctgggaaagaaaattaattgctaacagactataaaaatgactgatgaaaaactgtatctgtcagttgacatatgctgtatttgttatattgacttcaagtagaagtcaatataacaaatttgtgaatatatctgtagactatctagccctctgttaagtactgaataatgtaacaatgggctgttattagccttatacacatgagatctattcctggtaattaaaagtataagatccttatgtcatatacaggtgcttttcatgtctattttaacatgacattactatttccttatgagcggcaatgccacatagcgggtaggtgtgcagaccagccaagttgcctgatttcaaatcataattctgttactcactggctgaaaagtacttatccttcctgtgccttagttttcttatctgtaaaatggggaaataatagcatctacctaatagggttgttctgcaggattaaatgtgttatatttgtaaagcttttttgtttgtttgttttttgttttgttttgttttgagacagagtctcactctgtcacccaggctggagtacagtggtgccatctcggctcactgcaacctttgcctcctgggttcaagctattctcctgccttagcctcccaagtagctgggattatgaccagctaatttttgtatttttagtagagacggggtttcgccatgttggtcaggctggtctcgaactcctgaccttagatgatccgtccacctcggcttcccaaagtgctgggattacaggcatgagccactgcgcccagcctataaagctttttgagcagtgcttgcacattaataccttgcaagagctggtcattaacagtactactattaacacattctctcatttgactctcccacatacctgttgaagtagggaggcagacatggctccattttttgctaataagaattacatctgacatgctccatcggtgaggaggtggtaataaaactctgattcgtagcagggttccagttctgctggtgtgtgcaatgtgacctataacaataagcctacttcttcctttgggcttctgattcacaatggaaacccttttagttgtggtcattcagagatcacgcaacagcaaagttctattatgataagaaccttcctgttcaaaactgtttgacttccagaagacaggaacagaccttcaatttaatttcacccctatatgccagctgaataacagagggattttctttcatcctggcagaaaatgtgtgtgcttactttttcattaataacccttgggcaaggaaaacatcaagccacaaagaaggctttctcccctctaccacattttgttattgatgaatcagatatgaatatatggaaataaccagagaatcttcaaacactatgaatttatacaggacactttcctgctgtggaaactttaatttcccagatattattaaattcaaacctacaatgtttttatcaagaaggctagaacgacagcaatgcatagaaaggcaatggactatctcaaggtcatgcacagcaagacagtgaggaaacacagaggcagagaaccatctcttggtgcaaaacattgtccttcagactgcccaatgcatttctatttctggcacggataagtgtgacctggatatctgtaaggtcaagtcagagttgaaacagaccatttgcattaattatttaattcctgcaaaggacatatgctttggcattgctcaatcagtaccaagtagagctgtgttttcattccctgtaggaaggaaatagtgacacgaagtatggccgtactaactacctgcagcactgttctcccctctcagagaagtctaccccccagaggcagaatgcacctcctcacagtgagaatgggctaccagagaaaagcctgaaatttacatgactaatctttgaagtgctttaagtactttttttccattgctgaaggaaaggaatatagaggtacacgtgcacttaaccaaagtcaataccatacaaaaaccattagacaatttctaaaaatcatttagcagtgaaaatgggataggggctgggtgcagtggctcactcctgtaatcctggcactttgggaggccaagatgggtggatcacttgacagcaggagttggagaccaggctggccaacatggtgaaaaccccatctctactaaaaacacaaaaattagccgggcgccgggcacagtggctcatgcctgtaatcccagcactttgggaggccgaggcgggtggatcacgaggtcaggagatcgagaacatcctggctaacatggtgaaacccgtctctactaaaaaatacaaaaaattagccgggtgtggtggcatgcgcctgtagtcccagctactcaggaggctgaggcgggagaatggcgtgaacctgggaggcggaacttgcagtaagctgagatcgcgccactgcactccagcctgggtgacatagcgagactccgtctcaaaaaaaaaaaaaaaaaaaattagccgggcgtggtggcatgcacctgtagtcccagctactcaggtggccgaggcatgaggatcgctagaacctgggaggcagaggttgcagtgagccgagactgcgtgactgcactccagcctgggtgacagggtgaaactgaaattagtctctataccacttacaatgattattattttcttcacctcttattctcttgttctcgctgagcacaggcaggtttttctaatcaagcatggcaaacaggcataggctatctgaactaatctccactcaaccactttattgcaatgggacctttcacaggtgtttgaacttctctgaaccttagtttcctcttttttgtaaagactagataacacctattcgttctacctgataaattggcaaggaaataaggtaacagataaaatgttaagctcaaactggaactgggcacttaattgctgaggaaaagtgtcaacaagaatctctggtaatggcaatggtgttgaggctataaaagccaaggtccaaccttctccataaactgagccttccctggtaccttgtggtctgagtgtctagtgcatggagggaaacacagtgcagagttccaacaaactgttttgacacagtaatatatggatgctaaattatgtactacagatgagtgtgtgtgtgtgtgtgtgtgtgtaagatgaatgtatatgtaggcatatatgcatgtgggtatgtgtacatgtagatgtttgcatgtgtctgcatgtgtcttggggtgcttatgtgtggtctatgtgtttgtgtgtgtgtgtatatatatatatgcatacatttgattaggtagaggcctggacagaaggctactttctggcaacaagtatctgggtctaaagaatagcaacaaaaatgagaaagaagaaaaaaccaaagaatattaacttttgtttaagtctaccactcagttcccagtactgagaaaatagcctgaaaaactgagacactatgactggtctctatctgaaaatgtgttatctcttttgagaatcccattgaattctcattatttcttttccctgagctcttaatctaataagtgacctttctcctatttgtccctaagataccatgccagaagtttttaatgttttgcaaattcacaccatctcttgtgaattcttgtgaataaaggcccaagtactagttccacaaatgtcagtggaatcagagaaaacttgtactagaaacttttgactagaactggttcacaatttgactcagtcttgcatagtacatgctgattactcagtatgtgcctgaggcagactaggatttgcagatagcctaggtttgtctgtgtttcatttagtctctaattgtaagcagctacctcagaagtaaaggacaggctggtaatgatcccagatgcactatgccaccttcttcagcacaaggtcttttctactcactgttaatttacatcaaatctaaactagctactcaggaggctaaggcaggaggatcgctagagcccaggagtccaaggccagcctgggcagcatattgagaccttctcttaaaaaaagtttaaaaatctgaactgactatattatcaaagggcttccacccagtctccttgagtaataaaacttatttgttggtgcaatatttacaatggcaacaacatccttggactgagagtaaatggatttctacctatgcaaaatcagcttcgcccatctgtctgtatattacaatgacctcaaatgacctcctgagaagacttctggcccacctgtggatacgtccatctggtggctctgtgctcacaagaagtattgatccaaccccagctgggtctgtgtctagttagtaacaacaagcagcaatactccaggtagttgctggaaaatagaacctcaaactctttgctgcttaatacctttcaaaagctcagctaagaacaacagtgatgggggatttccagaatggtatgtggtcatcgttcctttggatattctaaatttctccccagcctaaccagaccatctgtagaacaactcagactggcccccgtagaaatgttttctctgattaggtgatgtaattggcctccattgagggatatgacaaaaaactgccctctaaaacccatcactgtgtttatgataaagtcatgttacataccgtcctctctaaagggtccatgaaaaaagcttctctctggtcttggtatcaagaatagttctgcttttcttgggtaactggtctctttttacctatgtgtgttgtaactggtaatatttcacattttgcatggtctgacaacgagctcacaatcaaatcttagcctgcttcttctattgaaataaaacttgctggcatgcattttgaggactaacctcacctctggctatatccacatcttgttttgcctttgtctctttttttagtttgctaatttttaatttattctattttcctgtgtcgcatacattttgttagactacttttaaactcgcttgaaacaagttgaaatataaatacattagaaaaatgagaagtaacagtgaagcactgttagtggaccaaacataatacatgaaactgctcagaattctaattgtaggtttctcatttaacatactactcaatggtcagaaacaatatttagatctataaccaacaagcttaatgttaaagcctacagaataaaaacatgcagacacaataagtaatgagggaaattcagagatcaagttataaaagttaatatattttaaaatccattgtcagcctctcaactcttcaaccttttctgggagtcagctacaaaaaatattaatgtttcctacaacttctacttgataacaacatttcactgctcttcaaaagcacaacactccgaatcacctaccgtgtttgtgaataaatgcgagtccttgtaatatctgatacatgatattccttatagcagactcaggaaacaacttatttctgtatgaggcagaggaaaacaaagttataaatcaaaggccagatcctttgataataaatactaaagaataccatttgtccatacaggggagctaccttataaacaccaaatatagtcacatgttacaaaaacaaaaagattaaacatttgatagtaagccaaaaaaaagtttttcctccaacatagcatataaatatcaaaaaatctcctctttccatgatacaaactaaaactttaaaaatttttggtggggaaaatttgaggtcttccagatgaagcccttatgcaatgcaatggctaacattttcctcctggctgggcaaaacacacagcacactgccgtcattgtcaataaagatgatatttgttcattcagatcactcagaggagtactgtgaatggcattcattttgccacaaaaaatgtgcccaagaggctccatacggttcacctttgaagttcaaaattaccgtcgcaggtaaatttcttattagcctcctcttgccagcatgcaattacctgagtactgcagcaagagaggaactgaaataaacctagaacttttcaacagaggtctcaaaatccaggaagctgtgtccacccttgacttctagttgctctgcccatatgtcctagtgataatggaaaactgcaatgtctattaagtctgagcttctttggatgaataactcttcttttttttttgagatggagtttcgccgttgttgaccaggctggagtgcaatggtgcgatgtccgctcaccccaacctctgcctcccatgttcaagtgattctcctgcctcagtatccctagtaactgggattacaggcatgccccaccatgcccggctaattttgtatttttagtagagacagggtttccccatgttgatgaggctggtcgtgacctcctgacctcaggtgatcgcccgccttggcctcccaaagtgctgggattacaggcgtcagccactgtgcccaacctggatgaataactctaaaataagaaaatgactgcattgagaacagcttctctgaagctatcagagggcctctaaagtagaaatatgggtgggccccacacctaactggcagctttcaacatgaaagcccagtagcgtgaatgttaaaggattggagaaaaaatcagaataatgcaataagaaaagaaaagcacaccagcatggcacatgtatacatatgcaactaacctacacattgtgcacatgtaccctaaaacttaaagtataataataataaaataaaataaaaaataaaaaataaaaaaagaaaaaaaggagagaaagaaaacacaaaagcagaaagaaaacacatctgctttgcctatttatttctataataagataatgatgaccaaactgtacctctctttaatgagctggtaaagattttccttcatgtactcgaagataaaataaagatgatcattttccctgataacttcttttaatttgactacattggcatggttgagcttctttaaagactaaaaggcaaggaataaacacaaaacaaaacaaatattagagaaaatctgttgttgaaaaagaaaagtaatcctatgtatacttggaaagaaacaactaattttagaacctcagaaatgtgctaaattatattttattgacagtttaatagtatacctctgaaatttataataactttacatagaaaaactacttcaatgaactgagtagaaggtatgtattcgaccagtaactggtatttctggctgcccccagcaccaggcaatgtaccaaggctattttgggcccaccccctccagatgatggaattcaggctgtggaagaagccagaggggaatcaataaaagaagcttagatttttctagcactggagaatttgcagctgcagtgggctgagatcaccagctaacagtttgcagacactctgaataggaaattgttcaaaacgacgaagggttgatggcctgcttctcttgacttttgtctgactcatgtatgtccatgaggcatagagcactccttcttacaatgtgagtttgagttacagaggaccagaaggagacggaaggaccctgaagtaagacaagagaaatccctctgtttccaagaacaacgaaggcaaaaagtcaggcagtggatgaggaatgagagggtggctcagaaaatggtgcgtggccttatatgtgtgaagattactcatcttcacacatatgtacctttcctcttcctggaacatgtgcgtacatgtgagtatagccatgtgcacactgttttctgtttgtattgctagttctgttgatagtgaacaaatcaattttgtattagtaagcagcatccctcttcttgtacagcagacatacctaaaactgttggtttggataatcagaatctgataagactgtctccttcatgaaagcctccaagtgtcactttggccagtgagatgaatcctttaattaaaatagccctttcctcatacatagagaagagagtccaatattaagttatctttgaatttcactaaaaagaacatcctttttataaaacaaagaaaacatgtgaagaggaaagtgttaaaacaaatatcctcatctagaagaaaactcagtgataaagtacccagggttcaaagcttgggaatgtgtaatataatcagttacttcaagcagctggcgagagagaggaaatatggtcagcaaaagagaacaaaataagactctctggagcttcctccccagaagaatagttcctgccaacatacttctctggcagggaatcctcagctgttttggccaattgttttgctagatccttctagtatggaccaaaggggctgattacttctttcggtcgggttggattcctggttctccatgagtaacaaatataaacattgcttaacttgtaagtattcactaaactctcagtgatcacagctatcttttatgcctgtttgcttaaaacgcatcacaagcaatggctgaggtagctagtggatgagcagccttggggaaaattcattcagcagaaaatgaagtggttttaaagctttcctgggagagaattctaggcaaggagtggggtgcctccagctcttagcctgaagtgtgtttggagccatgaattactggccaactctatggcagctcacagcttttgtttctaggtgagtctcatgaacaagaaagtccctagtagtttaatataaaaagaattaattttgtgtgggggacgtcaagtgactggctttatgaagatgtatttccagaaagaggcatcttattttggctcaggaaaggattccaaagcagagatagaggcaggtcagttgtgtcagagtggagaagcagaagtagcaaattaagcccaatcaacagtccaaatgtggactgtttatcctcatggatgaagctttcagttggatattaccaatgttgtccacatcagggactgagaaacactttctaactattaaaacaacaatgtactgggcccccagggtatcctggggcttaagatgcagtgcttgctcttaagaggcaaacaacctaattggaaagtcaggacatggatacaaaatacatctaataaaataaagaagatcatactaagtgtcaagggaatgacagaaacaaggaccatcagagatgtgtcaaggagtaatcagcaaaccctgagtggtcagtgggagcatcaccaagatgtgacttgaaggaagagtgacacctggatgagcttgctgggagggagcgggcatgtcaggagggaagcccgctgcaggtaaggcatggaaactgagtggaggactctgtgtctgggggacgaaggatgagaatcaacctagtttggttctgagggagactcatctgtaagactttggctggagaagtgggcagggcgcaaaccatttggatgccacgtatatacctgctgagttcttctggtgaatctgctgccttaagtagagttgcagagggagatgcctgacttgatgaggttgaaaagtaaatggcgtgtgggaaagctgcactgaagaaagaagtttggaaggtaatgtaagaaaaggaaagaggtagaaactcaaggggagaagggcttgggacttttttgggttagagagaatggtgggcacatttatagactaaaaagaatgagcaggtggaaaaaaaaagagtttaatgatatgggaaggagggggaaattgttgcagcaagaacctacagatataaaaaattaagatggttaaaaaaaaccaaaacagcaaaggaacacggtaggcagaatataggcagcctatggtttcaagatggtgtctagaacagcatagtgccatgtaagactatgcttctaagaaaaatagcaccaggtgccattccccgcatgacatcatgggagcagggattcccctccctgccatggccgtgaggtgcagaatatccctgaagtccacagggtcttcatgggcagacatgcaaatgtacaggcaggcagcaatgaggagaaaggaagaaggaacagtggcgtggtgagtacccaggatttcccttcagttccctttgctgctggaatgaagcagctggcaggacatgagaaacgacagtgataagaggccttcagtgaccttcctttcccttccccttctgagtcagcaggcacaaaagaaggacctcatcaaggaggaagggatgaggaatcttgtaaggtgcgcctcctttctacctgcttctgccttccctcccctctgtgttcagggttaggctgtggcccagtgctgctaagtctgtgtgaggcccaacaagcgcgtgggtgtgggggtggggaggatcccagttggcagccgatgtggcatctgtgcaggcaaggaaagagtgggagttgtctggtggtcatcagctagaggagcagtttcttcaactatcttgccgaggcagtcacttgcttcctaagacactatgtgcccatagtttttctaaactgtatatatgagtaatctcttttgcattagaactaatacacaattagctgtctggaaaaataaaggtttaacatccaagccatggatacctctcagaacttcatgtcacagagaaaatgtccttggattatctttgttttttatctctgatgtttgtttttttatatctgatgttttcggatcatctcaaacttttattttctagaacagaggttggcaaactatgtcccatgggtgaaatccagcccaccacatgtttttgtatagtccacaagctaagaatatttttgtttttgtttttttaagactgagtcttgctctgtcacccaggctgcagtacagtggcacaatctcagctcactgcaacctccacttcccgggttccagcgattctcctgcttcggcttcctgagtagctgggattacaagcacccaccacaacacctggctaatttttgtatttttagtagagaagggctttcaccatgttggccaggctggtctcgaactcctgacctcaagtgatccaccagcctcagcctcccaaagtgctgggattacaggtgtgagccaccacacccagcccaaaaaagataaaaaagaatacttttataaatgaacggttgcaatcagtttgatgacagggaacactaactttgaactccaattaagttaaatattatgtcccctcaaaaagaatatcattcttctcactggaagacctctaatacagaaaattatactaaattattattacattttatattttataaataaaaattttatggaaatttgtttttgctcttgttacacatgtatctatataacatcttcaatatgaccttttagtcctagaagcataaaagactgactatctggccctttacagaaaacgtttgctgatccctgctttagacttgtaacctcacttccatgtacaggacccctttggagaaaaagaaagggtgtttttcagtattctattaggtgtttcaaacagggctgggtgagaggactaaaattagatgaagcaccactccactgcacaaggaagagaattatgcatgtaaaactcaatgtgatcaatctactctgacagagagaaaaattggaacaaaatcaatagaagaaggggcagggggaaaggaggagaataatgaatcccaggggcagggggaaaggaggagaataatgaatccagtcagaaggctgaataaaagtaaagatcggtgctccacaatgcttgacatggcacaaaagaaggacctcagcaaggaggaacggatgaggaatcttgtaaggtgcctcctttctacccgcttctgccttccctcccctctgtgttcagggttaggctgtggcccagtgctggtaagtctgtgtgaggctcaacaagcgcaagggtgtgggggtcaatgaatttcctcacagaaagtggagtgcaaattattagagcaagaaactgaagtaagtactgctattatgtctaggaaaaacactcaacaagtgattttcctttacgttaataattaagaaaataggcaataataattcactaaatcaacacattcaacttctttatattgaaatatattgatataagtgatccattaaagatgaaagctttctaataacagtatatacaattataccataatcttctgcttcagctgtaatgttatcatttgcctccctttccagcattagtgaaaaaattcaaatgaaatgactatatcaactataaatctaagcatgtacaaagctattttaatcatccataaattattccttggtatattaatatataccttaacctcccgaaggttcatgcattcctcccaggaataaaattttcttttcattctagaagagaagaaagaaacaaacagcacacttattctcagtaataggttaaactttgcttttagaaaaatgcttccattctgatcctaattaacagtacttaaagtgggtttaaatttctacccagtattatactatcccaaaccagcacttattttcaaacagcagtgcaataatcctaagtcacaaattttgccagtagcagtggtgtggtgcagtccaaagaggcctggactgctgtcttactctatactaactaactaaccttgctctggaaggaaattgctcaggcttattctatttagaccagagctgtccagcagaactttctatattggtgaaactgctctgtgctgtccaggatggtagccactagacacatgtggctaccgagcactttggcatgtggctagcacaatgtgggaactgaattttaattttaattaaatttaaatttaaatgccacatatggttacttgctatcatactagacagcagagttctagaccctctagtgcaggagtcagcaaactatgacccatgggccaaaacctcaccaccatctgtttctgtacagcccacgagctaagaatggcatttacctttttaaattgggggacaagtcaaaagaagaataatatttcacaatgtgaaaattttgtgcaattcaaattccagtttctataagtgaaattttattggaacacaaccatactcattcatttatatactgcctgtggctgctttcaaactacaacagcagaactgagtagttgcaagagaccatatggcctgtgaagcttaaaatatttacagcctggcccttcatagagaaagtttgccaacccctggtctagagcctcaatggagaaaagaaaactccagagttaatcagaaattcaactttcaaggttatatttttcagtgcatttcaatcacattgtctcatttgtcttatagcagtcctgtgaaacagataggacagctgaggaaacagaaacagagaaggtacacgactttcccgaggtcttactgctggccaataacaaacttcccatctctccagctcactctgtccttgtcacactgtctcccggtagagtgatcaaatcctttattcatgcccgaaatattatttagcccctgctatgtagtacagtaggtgccttgtcaggcactggagagacaatgatgagaaagacatccctcatgaaactgacatcatggcaggaaggtagaaaataattttctgtaccaagtgctgtgaagaaaggaaaagggcctataaaagtgaacctgacgggagcagtggctcagccaaatgatgcagcaatttgtaggtcacataaacatttggggcttcatcctaaaactgccaggaagacattggaagctgtcttggtttggattcctccaaaagcagggcctgggcaagaacttgggtgcaggtagtttatttgggaggtgattccaggaagccagggcaaggagcaggagactgagaaaagagaggtagggaacccaataatgggtgtatgagtaagccaataacagggttggcaactggctcaggcaggctggggaccttttaaggagctggacagaatgcaccttggttgaaagtctcccacatgcacttgggatggggtgctggcatgggcatagagctgtgcgctacagctgcactgacatcaggtgggagcaagggatgtgttcatggaacacaaagaacatttggtcaagtagttttagatgattgaagttgtatgtttaaaataatccctttggtctgatatgaatagggggaaaaaagccaggagccctagtggcggaggacctcatggtggaggtggcaaatggtaatgggttgaatggaggttagcagtgggaatatacagaagtaggtggatgacataaatattacgtaaaattgacagtactagatgactaaaggtgaggcataatggggagggaaggcaggaggactcccaggttttgagggtatagtaccaattattgaaataggaaacactgaagaagaaacaaatttggggtaagagagaatatgctaaatatgagtgtagttttgggcatggtgagtgtgaaatgtctgcagggcattcaaatatagatgctgacaagtcaactggatagagatagttgtggcagtctccaatgtggttcccagagactcccacctcctgctacccagggccttttagaaccccctctccttcaacgacttgcttctaaccaacagaatatagcaatttgacaaggatgtcacttctgtgattaatttacaaaagcaagatatgacttccatctcagtacaagtctctcattgccttcttgactcccaagttttgatgaagcaaattgccatgttgtaagctgctttttagatgcccacatggcaaggaactgagggcagcctcccaccaacagccggcagggaactgaggccctcaggccaacaacccatagatcaactcacaatcacaaaatgagctcagaagtggattcttccccagtccaatctttggatgagaccccagctttggccaacaccttgactacagcctcatgagagatactgaggcaaagaacttagctaagttgtgtccagactcctgacccagagaaactgtgagataataaatgtgtgttgttttaaacaactaagtcttggagtaaattgttacacaataacagataactaatacaatgtgtctggactcaggttgtgaagggcaagggggtgcagagggaacaagacagcagtcaccagaccaccatacgcatgtagatggcccaaatgaagtcatcttatttcttagagtttcagtttcctctcatgtaaaatgatgtttattaacctgcttgttactacctcacaataagagaaaacacactttgataacaagtacttttactatgtgcaaagtagtaaatctaaagtggaaatgttttcagacctctaacatgagtgttacagagtcaataatcatctaacccacagcaatcattatctaaggttcttctctaggcatcctacccactcccctttagaactgttacaaagacgggtaatggtgagggtagagttaaaattatcatggcagtgaaggatcaaacttactttttaatagcgatcagctccccagactcaatgcttcttcccagcaggacggaaccgtaggttccatccccgagctgcctgattgttgtgtatctattcatggtgtgcctgctcaggccggacactcatctcacggccgaagtggttcagttctgcagtggtagcagtcctccccagagtgtaaccagatttttcgatggcagcaccagcacaaggtattcaataggacgtgactgtctcccaaatacatatttccaaaaatcagtcttctgcctgcagagaaaaatgagagacaaggataaatgttaatatacattttgagtatacgtgtttttgtaagtctaaatctgtgttttattggaacacagtcatacccacatacttgcataccattcatgactacaacagcagagctgaatagttgtgtgacgctgtagagcctgcaaagcccaaagtacagcaggttttggaataatgttgtttcattataatgttgatgagggacaaaaacttgattcccggctggggctgctgtccatgtggagtttgcacattctccctgtgtctgtgtgggttttctccaggtgcacactaggtgaactggcatgtctacactgtctcaggcttgagtgagtgtagggtgggtgtgtgaatgtgccctgcaattggtgcctgtctagggttggttcccactctgggccctaagctgctgggataggctctgaccacccacgatcgtaaactggattaagtaggtaaataattaccttaccttttttttttaatctttcttaaatgtatttatagctcacatccattccaatgtttaatattcaaagtgttttagtctttatttggaagtttggtgatgtttttatgaccagaaatatgctgtaggaacttaactcttgtttatatcaattagcctatggcaaaattggttttgttatatgttgtttggcataaagtcacagtttccaaagaacctattgataagttaaatgaggacttagtgtattgactatgttgccctttacaccgttcactaacccttggtctaaataatgctcttttctaatttcttatacaactagagatattatgcttggaaagtaaatttgtcactgactcagaaatgaatcagctccaattcaatgcttttctgctgactaaccattctgggcaaacactgagagataactgtggtcgatgaaaattgccaagctatgaaaatttcgctaaatatactgtgttctatacacttgagctacaattaacaatgtaaacatacaaaagctaagaaatgctaaagttctcctgatgcagaacttaagtgtgctccatgaactacgtgtggctaagcatcaatggtattattatcactactagacattcagaagctaaacaaagaactaggaattcaaggcctatgtgcagggtatgctccttttaaagtcattcagtttgtgtcttaaaaataatgtcattgatttttcatttatataattcagtctgcctataataaagaaactgtagtaataatgtaaagtgactagtattcctacaaagtgtccagatcacaaaagacaaggacagactaaggaactgtcacagattggaggcaattaagcagacatgccaaataaatgcaatgtgggatccttcacaggaccctggaatagaaaaggacactagtgaaaaagttggtaaaatctaagtaagatctgttgttagtagtattgtgccaatgctaatttcctggttttgatcattgttctatggttatgtaagatattaatattagggaaagtggggtgaagggtttctaggaactctgtactatttttgcaagttttctgtaagtctaaaattagttcaagattaaaaatttaaaaataggccaggcgcagtggctcatgactgtaatcccagcactctgggaggctgaggcaagtggatcacctaaggtcaggaatttgagaccagcctggccaacatggtgaaaccccgtctctactaaaaacacaaaaattagctgggtgtggtggcatgtgcctgtagtcccaactactcgggaggctggggcaggagaatcgcttgaacccgggaggcacaggctgcagtgagccgagatcacgccactgcacgccagcctgggtaacagagtgagacttggtctcaaaaatatatatatatatattaaaaaataaaataaataaataaatccagactgtgttctcctgaaagccgtgtgtgagcttgaaaaatcttaagacatataaaactcctgcctgattttaccatgctttatcacagaatcaaacaagcttttagagatcaagccccactctacccaccctcagctcattccctttcccctagaaccactgtaaggcctctggttggaggggcattttccttcttgaaactcttcaggatcagactccctacaacctccttcagtagctctttagggtgatgtattccattgatgactaataaatatttataaagcaccttctgtgtgacagatcctatctttaagctctgaggatatagagaccaataaaatatggtcccttcttttaaagagcttagagtctcctggcaggggatgggggtgtggatgggaggggggaagcagatatgtaccactcatgaatacaaactaagatatttcaagtatgtggaggggaattaaggagaaagccctcttggtttccagctgggttaattccatctgggcttagggagggcaggaaaaatcttcataaaagattgtcttaaaaaagagaaaagtaggtgttttgtagggcaaatggggttctagcactccaagaagcagaaactaagaggcagggcttgaaattagggggtgggaaagggggaacttgtggaaagagttggcagagttttgtttatggaggaacccagatgccattttttaaaatacaggttttgactggattctgtactggagaagaaaatgcaataaagcaggggtccccaaacccagggctgtaaaccagtctgtggcctgttaggagctgggccacacagcaggaggagagcagtgggtgagtgagcattactgcctgagctccacctcctgtcagatcagcagcggcggcattagattctcacagaagcacgaaccctactgtgaactgcccatgggagggatctaggttgcgtgctccttaggagactaatgcctgatgatctgaggtggagcagtttcatcctgaaaccatggacagtagattagataaaaatatttatctgtgttaaagttattgtagttgtagttactgtcctgtgattcagtaagaatatagtttcattcttgggaaatatactctgaagggtttacaggtaaagggccatgatgtatgcaatttattctcaagtgggtagaacaaaaattttgtgtgcattgcgaggaaaacaaatggggtaaaatgttaacaacaggtaaatctgggtaaagagtatgctatggactgaatgatatccctcctccaaattcacatgttaaagccctaacctccaatgagattgtatctggagacagacctatggaaaggtaattaggctacagaggtcgtaagggtaggggtctgatacaatagggctagtgtcttttacctctcccccacacaccctagcaaatgacgacacaggaaaaacgcagccatctaaaagccaggaagacagccctcaccagaaaccaaaccatttgatcttggactctccagcctccagaactgtgaaaaaaataaatttctgttaagacacccagtctatgttactatgttatgtatggtagcccaggcagactaagataggatctatgggtattcttttggtattcttgcaatttatgtaaatttaaaattattatagattaaaaatttcaattatccctaaaatggtagaagaagggaaattttttaaagatacaggcatcttaaatgttttatcttagatcaaaacatacaaatgcagacttatttaatacaacttgttgagaagacagaacactatcatataccatggttcctccacttcatgattactgtattatggaatagattggattcaggctgtgccttaacccaaaaagtatatttggaccacagcacaagcaattttggctctgcatttgttttcccctttttcttctttatcttcaactatttttttcctatagcatacacacagtcctcaacttttgatggtttgacttacgatattttgactttgtacaatggcgccaaagctacatgcatttagtagaaatcgtatttcgagcacccatactattctgtttttcactttcagtgcagtattcattatatacatgagatattcaacactttattataaaatgggctttgtgttagataatttgcccaactataggccaatgtaagtgttctgaacatgtttaagataggctaggcttacaatgatgctcagtaggttaggtgtattaaatgtatttttgacaatgattttttaacttacaatgggtttatagggatgtaaccccactctaagttgagacacatctgtgtatgaatcctccatcattcattatttcactttccaacaaattaagactcccaaaccatcgttgtatgtcatcttcctaaaaaaaaaaaaaaaaaattcctggaagcttgatttgtcaaaaaaaaaaaaaaatcagccaactaataaacaatgtctttatttttattttttaaagaaggctttgccctatagacaatgggaagtcaattaaagttttgtaactagggactaacatgatcagatctgcattttgtaatccagttagaatatttttcttcatgtccaaccaaaacttgcatattctaacttaagcaaatttcttctgcctagttttctgtggatataacgaagctatgtcataaaaatgtctatgcacatgaaatgagtaatcaagcatgtgtctctcagccttctcctgccttaattacatgaccttttctcagaggaagcattttccactcctttaattacctttggcattcatctctgaatcctcacacatttctccatctccttgatgaactatggtgaccaaaacttaatagtaacctatattacagtagcatgtgggcttccctcatgctttttgcaatggcattatactactgatttatatcagttattaataataaagccttttttggataattaatgtcccttcctcatccacttaaattgtacaattggaacaatggttcctagattatcactgggaaagctatctgtgaaagaattaagagcttcattgaaatccagatagagtgggtcattcattcaatgcacagtcaccccaacaattcctccttgttatagtctgtcatattatcaaggaacaaaatctaattactgtggcaagatatgactctcaccataccatggcagttactttctaatttctaatgctacttcaggtaattacctaacaactatacaatggatcagactagtgtctcttcaagcattgatggcacatggtataattttaattaaactttaataagatgctaagcattatgcaaggctcttgggcacattatggataaggctagggtctctcctttaaatcactcacaactgacagatacacaaaaaatgtagaaactgctatgagaatgcagtagacagcaaccaactcttgggaggaggagagagatctgacaatccttcagagaagaggtagtattgagatattaaaaaatgaaaaaggttttcttacacagaaaaggagagaaagaaattataagtggaggaaactgtaaaaatgttggcgaatacaagagcttggtgtgttcacaagagggcaggcacagcctaatgtttctcaccctggttgaatacagaatcacctagagaacctttaacatttactcatgcctagccccagccccaagaagcaggtcaggatgggggctgagctttgagagttctgaaagttttccaggtctaatgtgcaaccagggctgggtacgaggctagagcgtaaaaccaattcaatggagggcgatggggcaaattgcaggaaatagctagaaagttagggtgggcccaattatgaacgagtatgtgtgtcatgcaggagttttttgtttttgcttttgttatttttttgagacagggtctcactctgtcacccaggctggagtacagtggtgaaaatcacagctcactgtggcctcaacctcctaggcccaagtaatcctcccacctcagcctcccaagtagctgggagtacttggtgtacactaccaggctttttttttttttttttttttaagagatgaggtctcttttttttttttttttcccaggttggtcttgaacttttgggctcaagcaattctcccactttggcttcccaaagtgctaggattacaggcgtgagtacacctggcctcacgcaggagtttgatttttatcctacagaagggagttcctcagagtttttaaagcagagaaacagcatgaataaaatccctctggagactacatagatgttagaatagagatcagaggcagagactaattaggaggttactccaatagcccaggtgaaatatgatgaaagcccaaacaaaggcactggactgggtgagtcttagatacaacaggagactatgggtttgagatagggaatgtgtgtttttgtgttatttggacaatgtacagagatgtgggttctgttttctcgggggctgaatttgaggtatgtacaaaacctctcactggagatgctcaataagcaaatagctctaaggttgttttatttttccccaaagatagagtattattggagttcttattgggaacacagcattcagacaaggctgatacactgtgtaactccagggtactccattcacatagaacacaacgtgaaaggtgcccactggagttgttaaataaggcagcctgtgttcagaataaggaatgcaatagtcccatcacatccttggtttactgctccagaggccaaacttcaagagaaatattaaagaacatagtgaggcatctaaatgaaagtacaagaagggtagatgaagaaacaccggatgctggaagcaaaggagacttggaaagccatgataattgttccaagtgtacaaaggatatcagagagaagggttagttacactaggtatggttccagagaacaagaaccatgaccactctttgagctttctattattcacattagtgaattatttcccatactgaaaaaaagtgaatggtattagccaaaatagcattagacaagaagcaccagtcagctcacagtccaatctgagcatatcctagcaggatgtggttaaatacatttgagaatggtattgttcagctattcatcctttttgtggtggcccaaatatgatgagtcacctcataatctgaaagtaaagaacaaaaacttactgttgcgctgggaaaatagggcgatggacaatgcactagaaaaaagaagggaccatggtaggcgccttcgctgctctactccatagcaatgcttctcttcttgcttagtttacagaacctgattttactcaggattcgacatactcaggcacagcagccaccccagggcatgaactatgatagatctaagccaagcaaaggaattctacttccttactaaaatctgtttaggagtggtgccatggctcggacttacgagaatgaaagggaagtgagctggtgaggaagaagagcttctgagaaggaatctactccctaataaagacagttgacaaagaagcggcattgaacatggctgtgtaaagtgtgatatttagggctgaggcagagacggctatgagacatcagctctaaagatgagaatcccagctgcagagggtgtattcatagaaagaggttgagtccttgatgacatcagtgagctgctgcttgaaccctgaaaatatatgcctttgggcttattgttctacaacctaattgaaggtctctgttgaagaagtcactgttaatctatccactacagctgaaagcattcctgatactatgggctacacccacttacagtgggctatactaacttttgtattttaggtgacaaaatacaaaattctctacaggaggtgacagatagacctttatggttagcatagttttgaagactgaaagaggtgtacagctggagacaaattagaagtaactattagcctaatgttcatttgctttccattatctgcttccattttgaaagaaaataagatgcaagtaagatacaaacctattgtggtaaaagaatgtccaaaaacggccctcagtatcactccaggttgcttggacaactagctagctgaagctttgtgaccttgtgcaatccagtcatgtgcctgtaacatggcaggtgggaaacatgaaaggattccactttgcatgacaagtggggcccaacatggggaccactctgcatgccatccatagtgacatttactacagataaccacagagcttcagtcaaaggcaaccaaggcaaacacagaactctcaagctgagttcttttttctttttgtgagacagggtcttgctctgtctcccagctggagtgcagctgtgtgatcatggctcactgcagcctcatgggctcagacaatcctcccacctcagcctcctgattggctgggactataggcatgcaccaccaggcctggttaatttttgtatttttcgtagagacggggtcttgctatgttgcccaggttggtcttgaactcctgagttcaagcactctgcccacctcagcctcccaaagtgttggggttacaggtgggagcccctgtgcccagcctcaattggagttctaacaggaaaaaaggtttcagcactctaatgactatttttagtgtattaatgttaatacatccttctttgatacttaatgggagacatctacatctacagagtcagtgcttcaaagaaagaagcaggcaaatatcaaaaatttgatacttgacaagacatcacaattccagcctgaaatctctgagtatatgacattagcatacaaagatttcacactgtgtagaccagagaccacatactggcagcataatatttcacccgtaagtcactccattgagacctcactccacaagtagaagaccgtttctactgctgggttctttacaatttgttaaaaaaaagaagccaactattatcttttctatggttgtgaggtttacttgcatttgtgtgtgtgtgtgtatatatatatacacatttcacatacatataatattcatatattataaatacattatatataagtatatatgtaaatatgtgacatatttattttataaaattatataggctgggcgtggtcgctcacacctgtaatcctagcactttgggaggcccaggtgagcatgttgcttaagtccaggagttcaagaccagcctgggcaacagggcaaaaccccatctctacaaaatacaaaaattagctgggcttggtggtgcattcctgtagttagtcctagctacttatggggctgaggtgggaggattgctggagtctgggaggcggaggttgcagtgagcctaggtcacaccactgcactccagcctgggcaacagagcgagaccctgtctcaaaaaaaaattttttttaatttaaaaaagcatataaatatgcatttttgatatacagcaatatctgaaatacgcttaagacacttaagtgtcaacaaagcatcactcaagtgaaaaattaactataaggccctacgttcagtactgagatataagatccacagagctgtgggtggcagatctggcctctggggacttctcacgcagttggagaggtgggaaatacacaaatgaccagaagacatggacactggattaagttcctacatggagtggagatgagagtgctaccagtgcacaaggaaggagtcactttgtggatcactggctaggaatctcaaggaaggctctgggccaccaatttctaaactacagctaatttttcttgttaaggacatgtcacttatccatattttaatccaggtataaataacaaaaaaaattttttaaactatacaaagttttccttgtcagttatattaatttcccacagctgctccaaaaattttcacaaagttggtggctgaaaatagcagaaatttattctctcaggtttctggaggtcagaagtctgaaaccagtattcctgagttgaagcaaaggtgctggcacttcctccagaggctctagagggaatccattctttgtctcttccagcttctggtggttgcaagcactccttggcttgtgaccacatcaccccagtctctgcctctatgatcacattttcttgtcttctgtttttaaatcttcctctgtctctagcttataaggacttgtgttttcatttaaggcctaccaagatactgcaggataatctctccatttccgattttttgattcaatcacatctgcaaggtccattgtgtcatataaagtaacactcacaggttccaaggattagaacctggtatctttgcaggctattatttagcctatcactccctagcaaaacatcccaaagacttatacaatcatctaaattacacagcagcagtgttattcattcaaagttgggtgttttagaaatgaaatcagaaatctgtgcttacttacccagcgaacaaggacattctgttttaaaatatagaatgtacttatctcttttattttactttaagttccggaattcatgtgcagaatgtgcaggtttgttacataggtatacgtatgccatggaggtttgctgcacctattgacccgtcctgtaagttccctcccctcgtcccacctaccccacaacaggccctggtgtgtgttgttcccctccctgtgtccatgtattctcattgttcaactcctgcttatgagtgagaacatgcagtgtttggttttctgttcctgtgttagtttgctgaggatgatggcttccagcttcatccatgtccctgcaaaggacatgatctcataccattttatagcggcaaagtattccatggtgtatatgtacattttctttatccaagcatacttctaactttgcatagtgaacaagacttgacaattctagcctgaaatctctgagtatatgacattagcatatggagattccatgctgtgtagaccagagatggcacactggcactctgggggctgaatcccagatttaaaaatagggaatttcggcagggcacagtggctcacacctgtaatcccaacactttgggaggccaagggcagcagatcacaaggtcaggagttcgagatcagcctggccaacatggtgaaaccctgtctctactaaaaatacaaaaattaaccaggcgtggtggtgtatgcctgtaatcccagttactcagaaggctgaggcaggagaattgcttgaacccaggaggcggaggttgcagtgagcagagatcgcaccactgtactccaccctgggacagagtgagattctgtctcaaaaaaaaaaaaatcaataaataaaaaatagggaatttcctatataaatccctatttggagcttctctggaaacactgaaggtctaaccacctggggtccttagcccttcacggtaataagaagtggaagaaatgtccgtacctcttcaggctgggcgtgtgctctgcagctcaccacagtccccattttttgcctgttaccacttgccattttttttttttagctgtcatttttttgtgtgccttcatagccacttgttttactggatgaaaaatatttctctgttcctatgcctataacaaaagtgacaaagtaaaagcctgaaaaaaaaaaaaaccttatacttaaagaaaaattggaagagaagaaaaattgttcttttttagaagagaagagcaatttcttactgtttgacaagcacacacccagcttccttgagtcttttattttcctcctctgccctgacagcatttaaattcagcttctggtacagatagttaacactgcttgagaagtgaatggaatgtagcagcctgtccattaccttgagaattagcatgtatttctaactcgcagtatttctaaattctgctttgactccaagaattaacttggataaatcattcactacaacgaatctacacttagcaccctcatatatcaaatatgcccaaaacatgataattttagtacttagtatgtgcatagtactattataagtgcttatgcatatattagtacatttaaccctcataattctaccaggcaggtactattacaattatccctattttacagagaaggaaactgagacacaagttacatgtctagattatacgactaatgtggcagaaatgagacaggaacccaggctgactgtaccaaacttaagggaaagctttcaaaagatcatgaaatctttggaggatctgaaaatgacaggaacagaagtagtactttgtatctcaaagcccaaatatgaaaatgaatgatatggctatgttctaattgtcttcattctgcaatcaaatatcagcgaatcctctggagccattggcagcaccaacatgcccacagtggaggcaaagtgagggactggttccagtttccactcagcactgatctgctgtgcctcggggcatctcttggtccttgagtttacttttggtggaattagggcatgggacttgctctaaggtggtttcttcctctaaagctgtgtgattctgtgactctgtatcaggaattgagctagcatttgtctaagaaaaaaaaaaggataaatgtttctgctttttgcatcacatgaacaaaggttagcggagaagacagtgccaccgaaggaccctgtatgctacacacctttctttcaagagatgcacaagtgccccagtgcctcagccaggccccagtaaacattaaacatcgattccttctctttcgagctcacatgtcacctcttccaagcctcctgccccaacctacacatatagacccgagaatggtcctctcccttgatgccatagtgccttgtcctcacctcactgccagccccttccccgtggcaatgacctgcaggtgtaccctctgcttcagcctcgacactctccaagactgcttcatctttgtcttctcactccacttgcagtagcaagtcctcaaagattgtttgaagggcccaaatgtgagttttagtctttgctattattttctgtaccaccttggctaagtacctcaaaattctcagtgcttctattttgtcatacacaaaacaaagataaactgttgggcccaactaaaagttctgaagttctgaagtggaagaacagtgaataccacagaatagctggggcaggcaggcagcctgggccctcccacaacaatgccaagatgactgagtctcagaggatcacagaaagtccccctccatgcggtcagatcaggcctttggcctttgggtaaggctgtactcaactaccaaagaaagacagctttatctctctttcaaagagttccagcaaacctttgaagtcaatgttatgatgttcctggctaggtgacattggggaaaagcttcctgtgatttgccccaattccctcccctcagcgtcaatcctcggtggaggcaaagaacatttgctcatggccagcagctcacatcaggtgccttgctcattcacagcctaaaaaatggaggcgaggggcagggaaaattgtagttcattctttattttgaaaccttaatcaatgaattaatgccatcattacacattttctaagacaggagacaaaaagttacagcaaacttggggttctctgggagttgtggtttaccaggcccactgacaccattcagttccttagaaggagcttgtctccctttgcattaattatcttacattgaaaagattctgttactttcatttatcctcctaggaaaagtggattatatgcaaaatcattagatgacccttctcatggtaattctgagttccattttacctttacaggtttataattagacttcgtattctaggtttgaatgtgtcctaactttacaaaagtcagtgaatactgttaatttcttttaaaaaggtactagaaatagtatatccgggtttatgtttttctcctggacctaattcttctgcctctgtacattttagcaagcaaaccttttaagcattttgcctcttggactactgctttttttctgcataaggaatagcagttacaaagccaaaaggaccttctttacatggatcttgctttgtctttaccttgacagaggagtgaattaaagatgcattcagctattgcatcaactggatgttaacaagagaagataatccgttacatgatgtgccttcttctgtgccccagaaacttcttcatacctttaccatccctctcctctttcaatcccagcttctgaaaaaagaactcgtcctgcactaggtccttaatcccatgagaagcttccataactccctgtcgcttctcttacaatataaaaggtgctcacgccttgaaccttaaaaaagttcttcaatcacttgcagatgatttttaaactaggacacatagttggctttggtggactgtaaagaactgaagtaaaggcgaaatgttaaaaaaaataaaaaataaaaaaacagccagaaaaacaaacctttaccctgccatgtgtgaaactgtagatgagctagaacgagagtccccagcttaatgaaaactgccgagggtggcaatagtcctgcttgcctgtgtttcaggggtgggcaagataagggatagtgaagataggggagtgactaagagcatatcacaagttcatgtagatagtaactttcatgatactggcaaataagtagctggacgttacacaataatactttacctttctggttctaacgcattatcttttacggtagttacaaggacagccacatgttatcagtatttatatgctattacaacacatttgactaaggagctgatctcagtgtaagatgctttgctagcatgtatacaaaaaatcaaaatgaattaaaggaagtaaaggcttaatgtaaaaataaaatagggcagggataagcacgttttttctgtgaagggtcagtaaacaggataggctttgcaggctctccatctccgtcacaactccactctgccattgtagcatgaaagcagtcaaagacaatatgtaaatacatgggcatggctgtgttccagtacaaatttatttacaaaaacaggcagcaggaaggactggcacacaagccatagtttgtcaagccctgaagatgaggaaatcccccaaataagcagaagcactttagtactctccatagagccctcacttacccctaggttacagggctacatacaagctgtgtttaaccttagaatataagctctgtgaggtcagaaacgttgcaatattcacaactgtattcccagtactcagttcccagagaactggcatagttggcacaagtacggactcacaataaagacatgttcaatgaattaactaatgaatgaacaacttatggagctttaaaaggcaatcctgaccatagatgattttcctatactaccacgtccaccctcactgtcatcccgtcacgccccacttctttgcaaactggacaactgtactgggactagggtaccaaaattatgactccttctaaaaacttttacactaatttaggaaaaaacttgcttttcaacagctaagatcacatgaaggcatgtatatcttacatttttcttactcccctttgtcttagttaaatcattctctagtaaattctctttcaaagcaaaggcaatgtccaagagggcaaaaccattaataactatcttttgggaaccacaagttcatgcagatagtaactttcatgatattgccaaatacgtatttgggcattatacaatagtactttcctttccggttctcaggcattatcttttatggtagtcaaaagagcagtcacatgttatcaatactttatcacaggtcatgcttcacctatagaaaggtaaaaaataactcacactgatctctcctaaaaaaacgtgtggttctcataagctctgggccatcgttatacatttattaagtggctactaagggttcttgacatggtgggaaaagcaccaaatgaaaagcaaggcactattgtggccctttcatttcaaaaaaagtgagttaggatgacaatcatctgctaggaactacaagttcacgcagatagttactttcatgatattgtcaaatatagttggacatcacacttataatactttatcttttggttcagaggcattatcttttatagcagccatgatgagcttatttaaagataaaatataactgaatgctaattaacatagatttgaatgctaaattcattaggaactatgttcaaagcctaatgttgaacaaacttcagacaatagagttaagaattttttttttctgtaaaggaccttaatgatcacttgacattctcactctacagatgagatccaactaagaagaacagaatacttgctatcttcagagtagaatattttgaaatgtgtgagtataatacatgttttatagccaactaaagatgtatcaaatgttccccacgtgctccttggtaaaaagcatatgaatattttgctaatcctgagcccatatagtttaaaaaaaggggggagcagatgtttgaagatgtgctatcctcaaactcaaacatgacttcacatgtcaacatatgttggatttgatttcagcctgctcaggtaagtcccacgacaagacactcttcctacccaggaagacttcaactttcaaagcacagagagtcaggtacttaatgtgcaaagatagttcagtttccttggaagaaaatcaggaatagaagccttctgtttgggttgagtgtttccctaaaacctgttgagtagtagtttttcctaatattggacagcagttaactaggagcagacagattgaatgaagatgcccatatcaaccttggttaccaccttgaggtaggcctgagctgctgcttttacttctttggctgcaatcaaaggcatctctgattttcttcctgccacaacatttccttagcattttaatgcaatttgccccagaaaatgatttgtttcaccaaattctttttactaggtaattttctagaacacatgtgcttttataaggaagttaaaactgtatttcaaaggtaagcacaaccacaaactaagacacaattacactgtaatcccaaaacgtgtataagtcatccggcacacacacacctctgtttgcgcattctccctgattcaaccacatcaaccataaacactgaggttcacagataggagagttctaatactctaaacataggcccttctcagaaagccacagtcatcaaagaccacaggtgaaagacaacagttaaatgagatactattcacaggctttcagatcaacatacacagagaggtcattatatccagaattctcccaaggaaccaccaggcaaatacacacactcacatagatcccacaagcagaaaaatgcattttataagggcagacatcaatagaacggctaggtaccactccaactctgcaagatcctacaaaatgaaatggaggagactgctgcaagaggagcagtataaaaaaaaaaaattaagcagtagtgttcctggcaaggttcagatggaaaaacagcaacagatcccagaagcagagctgcagccaggaataacctaagctcaagccattttaagtaagggcaggataatacttactaaggattcactgcatggttaccctggttctctaggcctccaggctgagtgttcaggaattggactctgttaagttactgtcaagggataagcagacctttatcatgtatatgccagttatgggtaggcactatagaccatcttcacaccacaactcgggggtgaaactgggggggagcattttccctattttgcacatgagattaatagtaggagaattacagaaggccacacaactaataagtggagtcaggcccttgccccaattctgctgtacttcaaagcccacaataccacattaccatgcataacatatggctccggccctaaagaggcttaaactaacctaaaccaattggagatcaatacagccagtataatgaagggctaacaagcaagtatcttgagaaatagaaagaggaaatattataagagaagtagacttaggctcctctgaggacaggtaggagtcgcacaggagagtaaagagaagggaggtagtttctagggaaagcactatgagcagtgacactgcagtggcaagaagcctggcaccattagcaggacagcaagaagaccagactgcttagagtgcagagatgcatgctgaaatgaaaagaggattttagataggaagggaaaggctgattatgataggccttgagaagtcaggcatattattttagacttgagatagtacataatggagagaaactgaaggttgcacgtccagaatagatatgatgaagtgatcattttaaagattagacaggcaatagaacactgaaaagaccagagggatgcttctcattcattcattcattcagcaaccatttaatgagagcttactaagagtcaggcttgggaggctgttgcagtactgcaggagtggaagagtgaggactagattagaatatagaaggagggatccatataaaacatatttcaaaggtcttgatgactcattgatacagaggatgaaggaaatgaaggaaaagatggttaaagataattccaatgtttcaagattaacataatttccactgtactaggaacctcaaaaagcaatgagaataacaaacaataaagtataaaaagggctctgatgatgttgaacagtcaataaataaaactgctaaatggcttgtttgatatcctagtagttcatttacacttagtctgtggagaagaaacttcagtgaaaaggccttttctttgtgattaaatgctgagttcccttggcaaggacagcaggggtctacctaatcagacaggctccaataaccctccagcacacccctccaccatctgaacctagattggtttcattaggaaatgtgacggcctccctgctgcctggccaccagttttgactttggagaaggggataaggcaaagcagaaagggagaaataaaaagtgggcagagtcacttagagaatggggaatggtaccggatgtcattttaaataaaggatcccagtactgctttcctttctacatctacttctagtgttttacaagtcctggtcctcaagtagacaggaaagccttaaagagtctttaccaaattgtagcgcattgttcagaaactattttaaatgtgcatatttatgcatatattaactcccagcacagttcagcaaatgattgagacacaaattcttcttaataatttatatgttgactacagaaatttaaagctcatttaaactttatattcggcaatggtgccattcactattgaagcacaccctgaaactccactcactgggaaatgtgagaaatgaaaactgtaactatcaaacttctgttactacaaagagttctaccggccaaacaaacaaacaaaaaaattcaaaccccacaagcgcccataccttagagaaatccatcccgcttgtaaaattcagtgtggaattccctcagcctagcacagctccagcaaaagcaggtcttatttagttgtaagtggaaaggaatactcttctctgcagaatgatgcattagctatattacatataagtccttaatgttagtgtcaaagtcaaactttaaaaggttaacattacaaaagaatcagttgttctggaatatccgtcaatatccttctcataacagctactcagattagtaagaaagaaatcagaacagaaagaaatccagtaaaaaatggttgcaaataagtactcgaggatttttgctcagaccccttgtgggacagccaagggcctagtcagggaaattccgaaagcaagtcctcaacgtgccccgcaacgaggcttcaaattagctagggtcttccccctccttaagactaaaagataaacacccgtcaaaatcctccaggctccgagttttcataccaggaaggagagatccacaggatcgcggaaagaaactataacccattagcctcttcctgcgcctccgatccgtcgcggggccacggccaggggtctccccgccgccccatcccagcagctactacagtgacaggtcgcccggcagaagcccctaaatcccggagccccacttactggcgccgcgaacgcaggcgggggcccgcccctgaggtgagcgcagctcctcgacgagcggggcgcagccgcccgctccggagctggaaatggggacaatccctgctaggaccggccgagggctccgtacagggacgcccgcgaggtccggcgagtcgcacgggccgcacggcgcatggtagtgcagcaggaacccggccgttttccagcctccggcaggaaaacaaacaaaaggctgggtggcttctactggggacgaccggccgctttccctgggaaaagttaccctgcagctcccctcgctggccctgcgcgtccctgcactgcgtcctgttcgccctggctcgcgcggccgagccgccaggcgcagctctgggccgagggcagcacagcgcccagggacccctaacccccgctgaccgcaaggcgatctccgactccgaacgaacgcctcgttgcagatcggctcgatcaaccatcaagacttagaaatggaggctgtcgatggacgttctgagcacattaaattaaagataatcgttgtgaaaacatttttctgatttgaaaaaacgtagttgaggtggcacgacattgtgaaagtaatcaatgccactgaattgtattcaaagtggttaaacagcaaatttcatgttacctttacagaaaaataaaatgaaaacgcaactgattgcctgttagcattcctttgaactcttaagagtttttatgttgttagcaagtagttgtaaagactggactcttaacccagatgggaaactgactctagtcagatatcctctacacaacaatcgtcctctgtaactagttatagggaatctgacactaacacgtaattttataacacattgatttatgtcataagtgatattgtagacattaccttaaatcatccttataaggctagagcggtttgaataaagaagttgcttccaggtccctgattttaaatttacataattgttctaagccaacagttcttaaacattagcgggaagcatcagaaccacctggaggacttgttaaaacaaactcctgggctgcactctcagagtttctggtgctaatgttgctgggtcacactgctgtaagcaacacaaatttaattaataaagcagtaaccctttgacactttgtggactgttctctgagtttacaattcccagctgatcatatcagtttttttctcactatttttatttttgaattctacagactgaagattgttttttactgaaaaaatctataccaagacctgaatccttctctcctcttgatcttgtggaagaaacatgcaagatataagacagtcaagcttctttagatttcctctcccaaatggaaaaaggtcatctggccacttgacatatgtataacattgatatctacctttgtgtttacctatttaacagccagcccatatggcaaatgaaaactgaaaatcattatcagtgaaaagatagagacacgacaaggaatctaacaagtcatatactactcccatgaaaagcaatttctaaagtaaaatgatcagttttagtcaaattgtccaagcaggtctacctggcaaacaaaggtactgtcttggtctaccttttagcaagagtctgctaggctagtaagtagcctagatcagtagttttggcctcaggaaattataatcctgtaaatataatatgagaatataaccttgtaatgaggtctagtggatactgtggaactgactgaaaatagaaaattagtagctatgaagcataacagtattttaatgctcaatttatctttacaaatattattttattaagctttaattacttgctagaataaaagaaaccatctgtgtaattgaccaggctattttaaactagcactcaacattttaaatgaaacagatttgttcccaaactatttcaatacttcattctcagtatgtaagagtcacatttatcattttattctattataaatcttagatttaacctttccccccaatttaaatttcaaaattcaattttaaggagttcattgggaggaaatttatccttaaaaagacttaagccctagagtctcctttaaaacaaaaaatttaaatttttggcctcttttaaacagtaaggcattttttataggtagctgacttagggtgcaaataaaaacacacgcatccgaagggtggatcccaatattaaaacatggcaggccgggcgcagtggctcacgcctgtaatcccagcactttgggaggccgaggcgggcggatcacgaggtcaggagttcgagaccagcctcaccaacatggtgaaaccccgtctgtactaaaaatacaagaattagctgggcttgggggcgctcgctgtaatcccagttactcaggaggctgaggcaggagaattccttgaacccgggaggcggaggttacagttagccgagatggcgccactgcaatccagcctgggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtctcactctgtcgcccacgctgtagtgcagtggcgcgaacactgcaacctctgcctcccggtttcaagcgattctcctgcctcagcctcctgagtaactggtattacaggagcgcgccaccaagcccaactaatttttgtattcttagtagagacggggtttcaccatgttggtgaggctggtctcgaactcttgacctcgtgagccacccgcctcggcctcccaaagtgttgggattacaggcgtgggccaccgcgcccagcggatatactgcatttttaatctctccagaatagaatggattagaaatttaaactctgtaaactcgttgaatgtttggaagcctattagtccctggcaccactagaaactttaaaaactcagtaaatgtttgctaaattaaagttataggctatgaagcctatcagttttcacaaaacaggcaaacccgtagttaaaaagatttaaattgtgtaaaagcaaagtatcaccttatgaacaagtacattcactcaagaagaaatcaggtagtttgggctttaagaggtggggccgaggaccaagtgtaagttccggtgctcaaacctgagcggccgactacaaatcccagagtgcctcgcgggcgccgtctccacggcacttgggtttcagggccatggaatcgcaagcccttttcgcactgcattatgggatctgtagtgagacatgccttgcgttggctctttcctcctgctgggcgccaaagcgcgtcttttcctcaatctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggtaatgcttgttcaagttcgcttaagtgttcactcagcccaacacgcgggttgggcttgaggttcggcacccgggcagcctcaccccccgcgtcaggcgcgcgcacacagtaggtccgcgacccttagccctccactaggcagcccgcggggatgggtggccgggccgcccacacgggcagcaccggcactgcgcatgctcggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggtaacctggccagggggctcgagggtggacgccgcggggcgggagcgtggtgtgcagaggggccgggcctagggctgggggtcggcggggactctggggaggagtgggagcttcacggctgccacccgttagagggccctggcctgagaaggagtgcgtcggggggcggggggtgccaaccctggcttctccccaggattccttcctgctgagcctccccaacccccgccgagctcgatgtgaggaggagggtttgcaggacagccggggaaaatgtcccttctcggctcactgagtatattgaaccagtctcggtcctctcaagggattttatcagaagcattgagcatagattgaggtaagctgtcacagcgcctgaattcgggagggagctctggcaagaggagacacttgttgattgctcttctgcggaaaagccaggcccaccgacagtccctgccggcaccttgaggagccctgggtgtaggacgcatctgccccgcgaggcgtcattccctgggaggatgttggcaggcggtcctggcggagtggggttggagggttcgtctccgcggcgtcggtgccgtccaaatgagagactgagctaagttgcagagcttgacagtgcagattccatgagactgttccatattggaatacgtagtctctgccctatgcctttctttggtttagaataaattgttcatctgagaaactaatctctggctggggcttaaagaatcagggatgcaataattccaaacgatttaatttatagtggactcaaatatttattgcataaatgaatggctgaatttatttttattaaattaatctggaggatagaaaaggcaattgcccctgcccctaaactttcagaagtagttctctgaccgggattaagtacttagcctttataatttattaatcgcacctgtgaaacaggagtaacatgatgaagacatggactactcatacacatgagctattcaagtgaaggtgatatttaggtcaaactcgattatgaaaaataaaaggaaaacctccaggtggcatctgaggccctacttatttcaagtagtagttgaattgaccaaatgtcaactcagccgatcccagatataatagtttgtttttgtgatcatactgtcaaaatcaaagtaagaatggtttagagctccactgtaacacaggggagaagaaagatgctgtctatattacacttctcccatttcctttcctcatccttcagatacacattatccagatggcattttatttgtcgattcagccaatatttttgagtacctattagcctggcatagtgtgagactctggtacaatactagatcttcaatataaccaaacctgcaaggtgatttatgataaacttttaatcacagaatgtcacatgaaaagggacctcagtagatcaccatacctctttatagatgtcccatagacatgacagctgaggcctagacaggcctttactacaaatcaagcaatgtgtttgaccttatggttacagaggtaactgagatgtgttcctgtcctggatgccttaaatctagtaaatgaaacagccaacctcagtacaaatgttgtgataaaagtaagcacaagtgttatgggaacacaaaaatgttgaaaaatgcttctgactaagatgaaccctgagctgaatcttgaagaatgagtagaaatagctaagtgaggaagaaggcattccagatagagcaagcagcgtatgcaagccaactggacagagcaggggaagctcttgaagtcagtttagaatgactgctaggcaagagttagaaaactaaattacaaaggataccccacagaactcaggtcccctcgcattacctgtacttagagtttgcaataataaagcagactcttgagaagagagagaaatacacttctcagtgggatttatacgctcagtctttcattacatattttcctactaatggtgttcttagtaggaaaagctcccaacttaaagaaactaaaaaataatgtatttgacaatacattaatccttaaattttccatttttctagaaattcatctgagttcttgatctcatttatttcttcacagatgtgtgctttacagtgtgcccagcattttaccatatactaactggttcaagtctgaaaggcacctctgctttgagtctgcttgccagagataagataggaggcaaggctaatttatgttctgtaatatagtgcaagtatatctggtagctgtgttaaagatgtgtgttaatataaacattaccctcccccccctggccgccctgaaataacatatgactaaaatttgcaattgtaaaacttaccatctttggaaccagtaaaattaaatgggttttattattatctagcttaccttgaaggccatttccctgattgccacatttctttacagtaagtgttgagcaagtttcatttcctaataaatctattagctaacagactgaactgaggcaacatgccattttcactggaaggtaggatttagtttaatttagcaaacatttattgagaataaaaggataaaattaaagtcatctgattgaaacctttattaggctccaagtcacacacagtaattccagtctagctttattccactgaagccgatccaatatataaaaattggatttatagacagataaaatagaaggggtttctttacaaaagcatttactattaaaagtctttgactaagctttcctagtacatataaaatacacagaagtcatattttcatagaacacatttaataacatgctagctgtataaaagaagtgacatcatcttacggaatatatatatatatgtgttttttttttttttttgagacagggtctctctctgtctcctgggttggagagcagtggtgcagtctcggctcactgcaacctgcatctcccaggctcaagcaatcctctcacctcagcctcccgagtagctggggctactgtgtaccaccaccccctggtaatttttgtattttttgtagagacggggtcttgccatgttgcccagccttgtctcaaactcctgggctcaagcagtccttccacctcagccttccaaagtgttgggattacaggcatgagccaccacaccctgcctggactgtattctcttaagtgatccatgaagcaaaaactatctgctacagccaggtatggctgcacaagcctgtagtctcagctactcaagaggtggagcagaaggatctttggagctcaggagtttgaggccatcctgggctgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttcctttttttttttttttttttttttatgatggggtctctgtcatccaggctggagtgcaatggtgcagtctcggctcactgcaacctccatctctcaggctcaagcaaccctcccacctcagcctcccaattagctgggaccacaggcgtgtaccaccacgcctggctgattttttgtatttttagtagagatggggtttcactatgttggctaggctggtcttgaactcctgacctcaagtgatgctcctgcctcagcctcacaaagtgtggggattacaggtgtgagccaccgcacctggccagaaaaagagaaaataatttttattatagattatcagtagttatgtatattaatgaagaatttggcttcatttacctaattagattaatcataaatcatttatgaatagtaatagacttgaattgttactttatattacacagttggccctctgtacctgcaggttctgcatcctgggattcaactgtggatcaaaaatatttgggggaaaaaaagcaatacaacaataaaaaataatacaaattaggaaaaatatactacaagaactatttacatggcatttacattataagtaacctagagatgacttaaagtatatgagaagatgtgcataggttatatgcaaatatgccatatgagggactggaaaacccagggattttggtgtcctgggggctcctggaactaatcacctgtggatactgagggacaactgtaattaaattgatttttggatggatgcaactgatgttaaatttggcgggggggaaatgttaggattcacaataacgtgagtactgtgggttggagtagagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcatgtttcttcaattgtgtctttgatttttattccattgttcccatacatatgcagaaattgatcataatcatgggtatttgtaggttattactgtttgcatggaatttaactgtttccatactggtttatagaatacttaaaactatgttatggctttctttgtgaaaagaaatatcaataatggttgcttgtagtttaacatgggtttaaagtattcaaactaaggcttacgcatgactcaaaacccataatcttaaaaagattgatgggtttgaccacctaaaagtttaaaacctgtgtataagaaaaggcatcataaataaagttaagagaaatagccagctggaaaaactgtttattatatatgggcagaggattcatctcattacatagagcactcatatatttggaagaacagaggataaaaagatatgagtggactgttaatggcaaaataatacaaatggccattaaatatttgaagagataattagcctcattaataatttaatcagattggtgaataatgtgcatcgctgtccaagctgtgagaacactcatgcagtgtacatgaaaatgtaaattggtacagctttctggagggcagactggtgatatggatcaaaatgaaaaacatgcattcccttgatacagcaattctacttccaggaaattaattttaaggaaatagtggggaaagtaaatatgcaactataaagatgtttagtatagcattgtttatctggaaaaacatcatacaacttaaatattcattacctgttattaagtaatgatgcatccatacagtgaaaacactacagccatttaaaaggatgaagtaaatctttatacattaaaagagaaaaaaagttgctgtaactagttaagtgtgtctcactgcacttgtaaggttaataataattatttggaacagctcatctagtagacattgaatgctgctaaagattctgcaggtcagagatctatgtgtaacaggttaaaagcgtagcaacaaagcagtgtacagaatatagagaaaaattaatttaaaacattctagatacgtctttttttaaaaaaaaaaaaggaagccaggaataacatatgcatccctgttagcaatggctgcctttgggcagaacgtgtaacccagtttgggttccccaggaagcagactaggtgaagattgctgtgcaggaagtttattaaggagtattcttgggatcaacacctatggaagggagagagggaaacaaatgggcagggagaagaccagctgcaatgcagtcttaatggactgcttagccatcctcgagggagttctgaagatgaaataccctttcagagatgacctgagttgcaaagagccaagactttattagccgttgatcagtcattgggtggggattgagaggacagtgtgattttgctgaggcaatacccaaaagggctgacaactcaagtgttttcagatagaactctcagcagtttgggtaacaagttctttatttctgaaagggaatctgggcaacacaccagagtctaccttatagggttcactttttatgtgcttttaattttttttttttttgagatggagtctcgctccattgcccaggctggagtgcagtagcacgatctctgctgactgccaacctctgccacccgagttcaagcaattctcatggctcagcctcccaagtagctgggattacaggtgcccgccaccacacctggctaatttgtttgtatttttagtagagacagggtttcaccatgttggccgggctgttctcgaactcctgacctcaggtgatccgtctgcctcggcctcccaaagtgctgggattataggcatgagcctctgtgcctggcctttacatttttgaaataacaaatatttgaaaaaacattttctttttgaaatacagaatgttaatagattttgggcttacctacagaatttttggcagcattcttaatgtctactagatgatatagtcattaaaaaattattggaagcttataacttcagtctgtaagtgatggcttatattttcaattctaattaaaatttggttttccaatataatttgacttttggtgtactgacatgtattttatgctaattttcttgattctttaagttttgagcagaaaattattttaaaagatgtatttaatggatatttaataattcagaagacagtgatttctggacttagagtaataagtatatacgtggaagtagatagatgttggacatattgatacattgttccagagttgagctacccttccttgatgagtcctaaaatgctgttctccccataggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacatttttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaaccaaaaagaaaaaacagaattttctaaatttattaatagaaccaaaaagattgctcacatgttaatgtctttccagaggtcttaatttcatgcagtattttgttatattttgaattgatcagcttacaataatgcattaatcatttccttattctggaaaattttgaaatattttcacactgaaaatattttgaatgctgtctaacattcatatctcttctggtacttactcacacagagtaggcacagcataccatttcatttcttattcttcttccatagaggctgccatctttttaccatcagatccaagtttgtgtttataattagtcatcaaataattggcattaccatgatgacttaccttctatctcctcttaatttttattttgaaataattacaggtccacaggtatagggaagtcctgtgtgccctttaacctcctccgatggtaacaacttgcataactatagtacaatatcaaaaacgaggaaatagacattggaacaatccacagtttacttggatttcctgagtttacaagcacttgtctgtgtgtatgtgtataaatagttgtttgcagttttattacaaggtagcttcatgtaaccaccaccacaatcaagatacagaactgttttatagttatatactccctttccctagccattcgtaaccactggcaaccactagtctgttctccattttgtaattttgatattccaagaatgttgtataagtggaatcatccagtatgtaaccttttgagattggcttttttcactaagtataattccctcaagatcagtccaagttactatgtatcagtagtttgttcctttttattgcagaatagtattgcatggtatggatgtaccccagtttaaccatttattggttgaaggacatttgagttgtttccaatatttggctgttatgaatggagctatggaaatatgtgtgtaggttttctcatgaacataattttcacttctctgggatgaaaccccaagagtacaattgctaagttctatagtaagtacatgtttgattttaaaagaaactgccaaagtgttttctagagtatcttatattaagttcccaccagcaatgtatgagtgatccagttcatcctcatcagcatttagtgttgctactttttaatttaatttaattaatttatttatttattttaagacagagtctcactttgtcgcccaggctggagtgcagtggtgtgattccagctcactgcaacctctgcctcccgggttcaagcgattctcgtgccttggcctcccaaatagctgggattacaggccccgtcagtaacgctgggctaatttttgtatttttacaaatttgtattttgtatctagaatgcaaaaagaacttccaaaacacaatattaaaaatattagcaatctagctgggtgcggtggctcacttctgtaatcccagcactttgggagcctggggtttcaccatgttggtcaggcttgtctcgaactcctgacctcaagcagtctacctgcttcagcctcccaaagtgctgggattacaggagtgagccactgcacctggcctttaattttattaatagccattctgataggtatgtagtggtatctcattgtcattttaatttgcatttctctaatggcttgtgatgttgaacatcttttcatgtgcttatttttcatctattaatatatattctctctctgaaatatctgttgatgtcttttctaattggattacatatatatatataattatttttttttttttttttttttttgagatggagtgtcactgtgtcaccccaggctggagtgctgtggcacgatctcagctcacagcaagctctgcctcccaggttcaactgattctcctgcctcagcctccagagtagctgagactgtagacgtgtgccaccacaaccggctaatttttgtatttttagtacagatggggtttcatcttgttggccaggccagtgtcgaactcctggcctcaggtgatctgccgacctcagcctcccaaagtgctgggattacaggcgtgagccaccgcgcccagccagatgctaatatttttgatgttgtgttttggaagttctttattctagatgcaagtcttttattgaatatgtggcttgtaaatattttcatcctcttaacagggcatttcacagagcaaaaatttttaattttgacaaggtccagtttatcagtttttccttttgtgaatggtgcttttggtgtcaagaactctttgcctagtcctaggtctccaagattttctttgttttcttttcttctaaaaggtttatggattttacatttaagtccatgatccagtcaagttaatttttatgtaaagtatgaggtttaggtcaaggttcattaatttgcctatgaatatccagttattttgcacaatttattaaaaaggctctccttctgccatccatactaatttttaatgcaggttttcaaaaatttttactttatatttttataggctcgagaactcttcctaaaagcagtagaagaagaacaaaatggagctctctatgaaggtaaaaattcagagcccaggttcatatcataacatttctgaataatgactctgttattaaccatatttttttttctataacttatttggtatagaacatcacttttcttaatacattcttccttcagtactcattggaaattggttccaggaccctttgtagataccaaaatgctcaagtcctttatatgaatggtgtaatatttacatataacttacttattatgtaaatagttattatactgtattttttttttaaatttgtatttattttaaatatttttgatctgtagttggttgaatcagagaatgtgaaacccatgaatacagagggccagctatatttgaaattgttttttaaaaaataaaaaatagaaattgtttttctatataacctgtctttttgcaaaaaaatattgctgggaaacatcatcatgttggtaggatgagcaaaataacttttttttacatttagctttagttattcttcattaataaagtatttaaaaattattcattttaaaatatgctctttttataggtgaaaattgcttcagaggatgggaatataaaggataaattgaggaaaaaatacatgtttttctttctaagttccaatttacatattaccaacagaaatatgtggtaatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatatgtggtaatatatgtgtcagctttgtgtcttttattaacccaatagaaatgtgtaaataaagtgataggactatttgccatattaggtttgtaattatgctttccttttgtgatagtaaagataataattgatgcataggaaaaatccttgtgcttgaatcgtttgaaaatgccccaaaactaacatcattcagagttactgcatttatatgcaagtttcttctagtgatatttttctttagatttttagaaaggcccagttgatcaagtccctgtgcagccttcattggtttgtgaaattcgcatctccacttagtgtatggtgtaattcatccagaataatagaacatggcagaatatattgaatcataaactcctttgtagggaaaaagaactagtcagcctctacagctccaagttctactggtgtatctctgtggggagagttattgaatattacagctctaaactacctgtctaggaaatttgtaaaaaataagttttgaagattacttaggtaaataagaggcagctgggctaaaagaagttaaatttaaaggataatttaaaaacaaaaacaaaaactattctttattccacccagtaggaagcatttaattttcctcaactctgtgtcttagaaaagtttgcttagaagtgtttttggccaggcatggtagctgacacctctaatctcagcactttggcaggctgaggcgggaggatcgcttgaacccaggagttcaagaccagcctgggcaatatagcaagatgttgtctctacaaaaaatttaaaaattagctgagtgtgctggctggggcatgcctgtagccccagctactcaggagactgaggtgggagaatcacttggacctgggaggtggagtctgcagtgagccaagatcgtgccaactgcactccaacctggacaacagagtgagaccttgtcttaaaaaagagagaagtatttttgttggctatagcaattgcatcttcagagcccaaagaaagacaactatttaaaaatcatgatacgtaagagggtgaggaaaaatatgggaagggctaatatataagagtaaaatacaacatcttaagtttagggaaaagtttctttctgagcattaaggtttggaaatagttttgtgtcactgaactgctgttgcatgtagaaaaacagaatttggccgtttgtaaagaaagttaccaaattaaaccacagttaagggtaatcaaaggaaatgacaaaaatgtgtggtcacagctaatttagctttatttcttcttttagccatcaagttttatcgtagggctatgcaacttgtacctgatatagagttcaagattacttatacccggtctccagatggtgatggcgttggaaacagctagtgcgtatataatttgatagatagtaatgcatagagtttgttaaagttaagcatctttgccctgttgactcttaagatggtgctaattctgttgagctctatactctttagtatatctttgtttataaagttgtagaaattttttaattagggaaattgcaagataacacatagaaatgcaccttttaaacagatacaaaaataaacagatacaaaaataaacagatacaaaaaaacggtttaaaaaaataaaagcagtagttactgaaaggagtaaattaaaggacacatttcaactttctgaaacctatttgaagtagaaagttttaaaatgtaattaggctaaatttggcaaaatattaataatggttaaaattgagtgatgggtacatgggagtttattacactagtttccttacgtatatgtttgaaattttacattttaaaaaaggcttctaattaggaaaatgctgaactataaaagatgttattattctcttaatgtttttagtaaaacattaaaactctaacatttatttaaaagcacaggtgcagaatatattcctaaaagaaatcatgtttgaattgtatagttgccactgcatcaaagccatgaagtagcattggttttatatggataaagatcaagaaaacttatttttaaggcaatacttttgcaagacaattataaaattgttttggcttaattgcactatctcccaaaactcaatttgctgatattagaagagaagggagtctgtacccatgagagaatgtcaggttaaaaatagacagtacagagaaaaaagttttggtaatgaaatattatattagctattatattaatatattccctctgtcatgaaataattgtcacctttattgataacatatgcttattgccaatgttttttaactgcatatggtattaacacttaagctttggataagtcatattaaaaacattcccaacaaggtcaatattaatagcctgtttaaattttcagctaataatattgttcaccaaattagagttaacagtatgaggtagttcatacttaaaatgaatcacttgggttttttctaaaccttctttaaatttgggtagagtcgtttagactcagctcttagccagttttataaatatgtgccagatgctgttaagaaagattgtattaaaatattaaagaggcatttcttttctttcccattttttatacaaacccagacgctatgaaagttctttaaggattcatcttttttttttaaataagatctgataagccctaaaagtttgcctttttttttctttcctgtaacatgtttgtagaatagccattgagtccatctagcctcaaccacacttatattttgttgtattacaaaatgcccttcctggtttttttttttgtttttttgttttttttaagtctacatcacttgaaacttcctggttttctaacttcgccttcatccaatcctctttgtaagtctgatcatctttaaggtttacttcagtaaaaatagaaagctcatttttctagcaccattcactacacatttgtgtatactggtagatgatttgtgaaccctaagatgttttcaaagtaggtattttcctctctaaaggtaggctgataaggcaaatctgttagaaaacccttggtaagtaagtacctcagatgacgtctgtagatttggtttttatccagttagaataaattaaggttaaagaacatactacgttaagatttttgaaaccatttgaaagcttgcagtaactcataaaatctctactttacaataaaattagttaaatctcaacacctgtatccaaaaattctaattctttctggatgataattactgaagcttttttctttgaaaaacttgatacagtattcctttgcaagacaggataaattcatcacatttaaaaatgtatcacatgttgaataagctttaggtgactttttgtaaagcaaatttgaaaatgctatgaaaaatcagtttctaaactgtacgcttgtagactgaggcacttaatttattcacctcccttttttcagcattgaagataatgatgatgacagcaaaatggcagatctcttgtcctacttccagcagcaactcacatttcaggagtctgtgcttaaactgtgtcagcctgagcttgagagcagtcagattcacatatcaggtgtgaatacttgtttttcataactcagtgagaaatatcttaaccttaaagatttccaaatttataaggtcagataatttgccagataactgctgctttagttcagaatatggtggaagatctagttataattatcatttgcatatactattaagctgttttgtgttttgttttgtcttgttttgttttttgaaatggagacgtgccctgtcacccaggctggagtgcagtggtgcaatctcggctcactgcaacctctgcctcctgggttcaagcaattctgctgcctcagcctcccaagtggctgggattacaggcgtgtgccaccacacccagctaaatttttgtatcttcagtaaagacagagtttcaccatgttggccaggctggtctcgaactcctgacttcatgatctgcccaccttggcctcccaaagtgctgggattacaggcctctgaggcactgcgcccagcccagtagtaagctgctttacaatctgaagcagaacagtttgtagtgctgttgtttaaggatgccatacctttttcagtaaagatctaacagggtaagtctgagttgttgaggtagccctaagaaaactggaggaatactggtatcatgaagcatttcagccatgttggacaattgtcctgagacagactgaatgtttaggaattaatggatttttgttcgggcatggtggctcacgcctgcaatctcagcattttgggaggctgagttgggaggatcacttgaggccaggagttcaagataagcctggccaacatggtgaaaccccacctctactaaaaatacaaaaattagctgggcgtcgtggcgcatgactgtagtcccacctacttgggaggctgaggcacgagaattacttgaacccaggaggcagaggctgcagtgagctgagattgtatcactgcactccagcctgggcaacagagcaagaacctgtcacaaaaaaaaaagaaattcatgtatttttaatatgttaaatattgtttggttcggggctttttcagaggaggacaattaaaagttttcaaggagatgaaaataactttagtgttaatagatgcaatatggatcacacacacatagattattttcctaaaacatttattttaatatgtctggcaaaataatcttatgagggaaaagagtgctttataaaaagtagcttcagatctatactgaaaaaacaaagatatttatgtcttgatgttaagaaccattattattattgagtagctaaatacattcatgctttagctctgagcaatacagagggtgtgattataaatttctaggaaggtataaatgtactgggaatgtagttgtgacaatagaatgacatagaggagagtcactgaaggatgattttcttttgcagtgctgccaatggaggtcctgatgtacatcttccgatgggtggtgtctagtgacttggacctcagatcattggagcagttgtcgctggtgtgcagaggattctacatctgtgccaggtactaagtttttgtttttgttttttaaacaactgaggcaatggtgaaaagaaagatggtcctttgccaatcctgataaaattacttgattggtgttctgagttaaagcttagaataaacaagttttgctaagctgtacttaactttctcaaataacttagaatttaaaggctagaatatgctaggtttctagggtatagaataatatgtaggacagatgtagtaacccatactactaccatagagtttacatgctagcttaactgatttgggaaaaagagttatattagaaaaatatattcaagtcatttttacactaactgtaaactcattgtggtaatggtttagattaaaacagcactagcattttcttatggctcattaaaagttattctatattttgaaaattttgctatgtgtgggaaaggactctattcaataaatggtgctgagataagcggctagccatgtgcagaagatggaaactggatcctttccttacacgacacacaaaaatcaaatcaagatggattaaagacttaaatgtaaaacctaaaactatatacttagtccttatatagaatttttaaaaacaacttgttcttaaaattcagatgcattatttttaaattaattccatttggaatcttgtagttttcataaaatatttgaatttcttgaagactctttttcacaattctgtgtgctagtatatttaacaagtacctattaaacacctagtggattgccactagagtctctagcactgttatgtcaacctaaataataagcagatagactctctaaaagacatttatttgagaataatacattgcaatgggaatacacatgccatagtaaactattcagggaaacaaaagtttttaaaggaaaaaatgaggattacataattgttttgaaatacttaatccttgactacaaagatcagtaacaagggggacgccagtctgagattggacagacagtttcttgggcagatgtccttgcagcaaaaatattttttgtataaggctgtgatggcctttgtgcagagctgtgttttttatagtcttttttgttaaccagtcatagaagcctgagaaccttctcttcatggccttcctcagctctctttgtcagggttttcttaacattagtggctccatttttattttaacaactttcacattttccccttttgatcagtatctttctctgatcagtcatcctgtagttaggttttgacatcccatagtaccagcatagaccagtcctggtttctagtctcatcccatgttggggagaatgattagcaactaggagtccgtgtcaaaatgcttttaagccacatttgggcaagaagggacgtctgaagggaatgactctcaggctgtgtctacctggattccattattaagtttgatttttgtctattccatagtctttgttactcaaaatgctgggccagcgttattgttaggtgtggtacttctgcagaaatttaacaagtaacaaagttaatagtaatatgacaattccaatttgcataatggttttgagccatgaacctaggcttaagaacaactaattgagtagaccagtgaccacagggaattaggtgagaccatgtaatcatgctacctgttttcttattttgtgtacatgggtctcaactttatcagagggatttatctaggtacagcatgtagtactagcaatagcacagatattttcttttttaaccaatgaatactaaaggatttcttgggttaggttctgttaagttaccagcagaagctattgattatgaaatttcaattacaccattatcctgtcaagtgaaaaaagtagcattaagtgggggtaaaagtcttatgatatggttctgatgtcatgggaaaagctgtctacagctttcacaaaaacatcagattctcctcctgatttatgtttgaatgtctctggtcatgatattgttgtgtggctcatatatcaggcatgagacttgtttcttaaaatttgaatagtttcagcttaaagggctttacgaacagaagcttttgtttttagttggcgtgttgtagtccaatcctggaggaaactaggagaattcatcaaacagtccggtgtacgtgtggataacaacaggtgtattgcagttttttttttaagaaacgtttttttcctacattgatcatataggaatttcagatttaaaaatctcttgaggctaggaagtcaaagagaggtagactttaggcttcacttagggtcttaaggttcttgggcctgctaggaagtgacaggttttactcacgataaggctgagaactcttaaagccggatgttttatgcacattcttaaatatgacattttcagtcaaagccttggtaatataactaatgtttctaattgtatcctcatataaagggattagatttttattgaacttatataaataaaaataatatgaatagtttctgaattttggagaaatcaagtagggagaaaaagcaaatggttccaccttggttcacaaaagtcttctaacgtcataaagacattctcttcatcatttacatcaattttatgtaattttttattatgcttgatctttattagcagttcaatgaacccatgaatttattagagttctggaaatttttatttagtccattgatcttaaagttagcaaaaatctttgttcaagagtactgctagagtcttttccataaacagcagttttggactgtagctgattgcaaatgtttttagagaattcaaaataataattgtgatgacaaaaacttagaatagccatgtaaaatctgatgaaagttctcagttgatgagggaatttagttatttctagtacatgtagcattttaagataaccagaatcatgactgacactgtcacatcaggactatcagacttttatataaatttcatctagtctttagaatactcacattaataacatctatacaaatataactttagaaaatatttgacataatagaaatttataactaatagcatactagatttttatgagtttacatagttttggaacatttatatcaataatatacccataaatgtaactgaaagaggatctaatacttattatttaacagtgcctcccatacagtttaccaagtgaggttaatcatttgatatatctacaggatgagagatacgttctttgaggctttccaggagcccaactagaaaatcccaaagttggctgggtgtggtggctcacgcctgtaatcccagcactttgggaggatgaggcgggtggattacctgaggccaggagttcgagagcagcctgaccaacatggagaaaccccgtcgctactaaaaatacaaaattagccgggcgtggtggctcatgcctataatcccagatacttgggaggctgaggcaggagaatcgcttgaacccggtaggcggaggttgcggtgagctaagatcgcaccattgcgctccagcctgagcaacaagagtgaaactacatctcaaaaaaaaagaaaaagaaaatctcaaagttaattttagattggaaagccttaatttaggatcttgactctggggaaacctgccagagatgtcaaaggttcaaaacatttgatcaaaacaaaattgctggccactgtgaagttacttatttaaccatactgataatcaaaagatcttaaaagcaatgcagaaagttacatggatgtaaaagccttaatccttttaaagctcagttttcgtaagtaaccaaaaacctaataaagcacaggcgttatattgataaaacaataaattttttttttaggccagttgccaaaaagataaagaaataccttttatagggtatttgcttctccatgtgggaaacctgtttagataacttgtaagttaaacctgattaaaagggtacttgaatttacttagggacaggaagtatccagggttatatgtctacattagagaggaatataaacaagaaaactagtaacttgagcaggagaatacatggctcttaaatagcataggaagtttcctggttacatggagtaattcagatgtcacataaagccaagagtacagaatcaagttatattggaggaaaacattgctcttctagacctttaaactaaacatttcaggccggacatggtcactcatgcctgtaatcccagcattttgggaggccaaggtaggaggattgcttgaggtcaggagttcaagaccagcctggacaacatctctactaaaaaagcaaaaaaattagctgggtgtggtggtgcacgcctagctacttgggaggctaaggcaggaagatggctgaagcctggctgcagtgagctatgatcatgccacaccagcctgagtgatggaatgagaccctgtctcaaaaacaacaacaacaacaacaacaaacacaggtgcagtgcctcacacctataatcctagcactttgggaggctgatgtggattgatgggttggacccaggagttcgagaccagcctgagcaacatgacgaaaccccgtctctatgataaaatagaaaaattagttggacgtagtgtgtgtacctgtggtcccagctactcaggaggctgaggcaggaggatcacccgagcccaggagttcaaggccataataaaccgtgatcatgccactgcactccagccaagatgacagagtaagatcctatctcaaaaaaaaaaaaaaaaaaaaaagagataaacatttcagtgtcaggctattaacagcagagctagaactggagggaaaaaattaagaggagttgacaaaaaggttgaaagagagagttatcaccctagccaagcaaaaagatacactctttcaaggggagagagaacagaaggcaatggtgtatgacctgcaaatcatgtgcaggagtggtacagcaaaagttgaacttctgatataaatctgagaagcttcagaaagaaaaattttaccttgagaagtgaaattaccattctgagtgaaaaagacagcatttccaacctggaactagggaaattaattagatcccaggaagaaatagaaactgtagttttgcagatggctgttcaacagattttagaatttaaaatcaaaacctcttatagttttattaatactaagagcaaattaatactttaagaaaacttcattgttctaacagaggaccaagttttttagttttgtattagtgtatttcttatagcaaagctcaatctttagaaagacttataaacaattctcttcaattatagccaacttgaccacacacaaaatcttttatgaaccttatcacaacttatattgatgacatgcttggactttctgctctgttgtataccttcctctttcttaaccagtcattttactttaggacaaaaatctaccatacaagattcttttttatacaaaattattctctttttcatctttttttaaccaaaaatatatccttgtaactttcttcacatctctgtctcctacttactgatttgtttcttatgccatattttgaaataaactttaaataacttccaaattacacaaaattcttcattatttaatcttggttcacatgtcataagcagtgagttttatctcaacatgaatggaaaagtcagcagattcaaagtgtgaagaaaaaaaatagagaacttagactatatatattctatagttgcaggtttttgaatgatgataatttgagctgtaaatttttcttgatgtaattttgcccatcagtttaaaaatgtgcacaacaataggctataagatgtagtcagctggaatcccagaaaacctggcatgttttaacatttgagaatcccattctgtttcttactactctctccagaggaaagaaaattctgcaaatcctgtcagagaaagtcaggagtttagacctgtgttttaggtggtggtgactgacctagtggtttgtctttttttttttttttccttttgaggacagtctcactctgtcgcccaggctgcagtacagtggcacgatcttggctaattgcaacctccgccttgcgggttcaggcgattctcctgcctcagtctcccgagtagccgagattacaggcatgcaccaccaccgcctggctaatttttgtatttctagtagagacggggtttcaccattttggctggcctggcctctaactcccaaccgcaggtgatccgcccacctcagtctcctaaagtgcaggaattacaggcgtgagccaccgcacctggccctagtggtttttttctttctttctttgtttttttttttttgagacagagtctcgctctgtcgcccaggctggagtgcagtggcgcaatctcggctcactgcaagctccgcctctgggttcacaccattctcctgcctcagcctctgtagccctagtggggtttttttttgtttgtttttgtttttttttttccaggcggagtgtcgctctgccgcccaggctgcaggtgcagtggtgccatcttggctcactgcaagctctgcctcccgggttcacaccattctcctgcctcagcctccccagtagctgggactacaggcgcccgccaccaggcccggctaattttttgtattttttagtagagatggggtttcaccatgttagccaggatggtctcgatctcctgacctcgtgatccgcctgcctcggcctcccaaagtgctgggattacagacgtgagccaccgtgcccggccagccctagtggtttttaattagccatcttctgcccaccattcagaatctttatttttgcttatggaagattttcagaagaagcaagggaaaagagtcaaaccaaatcaaaaaccaaaataagaacattcacaaatattttatcccaggcatgcagatcaaacaaaatattaaactgaatgcacagaccaaatcaaaagtaaattcaccagaagacgtgaacagaatgtaaatgctgtagaaaccaagaatacccaatctaaaaagacacttttctttacaccagaaaggacttaccaggaaagacaaaaagtttatcatctcaaaagggatgtatggtcctttattaaggtgaccttatccaaaccagatcccaaatgatatcaagaagcctctaccaaaaggaaggaggctcagcctgaaagaagattcaccagggcagaaaaggcaagccgtggaagtagagtgctcagagcactcaagtaagtactgcacactggttccaagaatctctgattccttcagttaatgatcttttcagatcccgcttctgacacttctgtatttcaacctaaataacaaatgcccaaaagttatttgggattagagcatcacaatgggaatacacatgccatagtaaaccatgtgcttattcagggaggtaaaggcaggcaggtttttaaaggaaaaaatgaggattacataattgttttggaaataattatccttggctacaaagatcattaacaagggtaatgccagttcaagtttgcacaggcagtttgctgggcagatgtccttgtagaagtattttttgtataaggtttaatggcctttgtgcagggttgtgttttttgtagtcttttttgttatcaggcatacaagcatgagaaccttattttcatggcctttcccagctctgtcaggattttcttcacattcatgatttaattttgattttgacaactttcatagttattccattaacttgtaattgtatgtgagaaaatactataaagaaggaattgggctggtctgagtgcagtggtcgtttacatctaattgatcacaaccagttacagatttctttgttccttccccactcccactgcttaatttgcctagcttaaaaacaaaaacaaagaaagaaagaattggttaagcaaatattcaggaataaaacttcatgtgtcatcataaaagtaactttaaaagcaaacattttaaatatacattttaacataagtttgaggggacttatctttttcaatctgacaccgatctaaatagtttttgcttcatttacttatttatgaatgaatgaacaagacaaggtcttgttctgtcgcccaggctggagtgcactgacaccatcatggctcactgcagcctcaaactcctggcctcaagccaccctcttgcctcagcctcctgagtaactggaactacaggcatgtgtcaccatgcctggttaattttttttttcattttgtatttttgcctagttaattaaaaaaaatttttttaagagacagggtcttgctatattgcccaggctagtttttacatctttaaaactgaatacttagctgggtgtggtggtgcacatgcctgtagtcctagctgttcaaaaggttaaggcaggaagattatttgagcctaggagttctgggctctagtgcactatgctgactgggtgtccacattaagttcagcatcagtgtagtaaactccaaggagctgggagccaccaggttacccagggaggggtgaactagcccaggttagaaatggagcaggtcaaaactcccatgctgatcagtagtgggatcatacctgtgaatagtctctgcactccagcgtggacaacatagtgagacctcatcactttaagaaaaacaaaccctgaatattttaagttagagatggagttagaaatacttttagttatagcagaatcatgtcaatttttagtacatcttttacttagctttttgcacacttttttttttttgagacggagtctcgccctgtcccctaggctggagtgcagtggcacagtcttggctcgccgcaacctccgtctcccaggttcaagcaattctcctgcctcggcctcctgagtagctgggactataggcacccaccaccatgcacagctaatttttgtatttttagtagagacagggtttcactatgttggccaggctggtctcgacctcctgacctcgtgatctgcctgccttggcctcccaaagtgctgggattacaggcgtgagccaccatgcccagcccctgcactaattttttaaacaaagtcctgttggtgctcccttcaaaatttatctccagtctgaccattttaccacttctgcaacaacccttctgactcagccactgttctgtttggtttgggttacatagtggcatcctacctggtcttcctgtttccactcttataccactagaccatattctccataaaccaccagagtgatcttttaaaataaaagcataaattatgttcaaaaccctccagtggcatccatctcatgtaaataaccactccttcctacaagatgccacctcacctgccccgactgcctcatcatagtttcctctgcacaatgcccactttgccacagctgtgtgctcctgctggctcttggatgagcccaccagtcacacttctgcctgagggccttgcacatgctctggttgctgcctgagatacttatccccatcactatgatcaccttcccagagaggcatttcctggcctccctatttcctcaccaccatcatttctgtctgctgactctactttgtctgttggttgatttttgcactaagcgtactaccagaagctttcctctcaatttgctttcccacagtaaaagagcagggcctttgccttgtccattagtttctcctcagaacagtgcctcccaggtgttcaacaaatacttgctaaataaaagatggctgatagcaaaaatatttatgtctatgtatagggacttagtttttattgacattgtgcttttattccctagagaccctgaaatatggcgtctggcctgcttgaaagtttggggcagaagctgtattaaacttgttccgtacacgtcctggagagagatgtttttagaacggcctcgtgttcggtttgatggtaagttggattctgtagaactcagcagaaatactgatctataatgctgatttttataaatacgccgtttaaattttctgtgatgaatgtgagtactgtaagcatgtttaaaggaaaccacagtaaatataatgctgggaatatctgaatattataatttttaactttttaaaattattttcataggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggtagcatttgttttttaaatggctttccatccagtctatgttttatatggttccttgcaggttaaagtaatccagtgcttctttcacttaatactggatgattttaaaagcaatcattcagggtcttaggaaaaataccaatttctgggcttttccttagaaaatctacttcagcaggtctttggagccttggaattgagttttactcaatcctagctgattcttttcaagcaagagtaaacactgttgtaatttgttacttcttagattacttaaatccacttaataactgatttagattcaatttgttttttttttttaaggactgatgcaattctactgggtcactatcgcttgtcacaagacacagacaatcagaccaaagtatttgctgtaataactaagaaaaaagaagaagtgagtatacgaggtgtaattaatagttttcttatcttaatagcctattcatccaagcagtctcgattagaacaacaacaaaaaaaaccctttctgattatttatactgttatataaaatgtatattaacttctagcaatcactgaagaaagctggagagttttctaaaatgttgttattttttattggatcagcttttttgttttttaccagatagtttgttttttatatatgaaaatgtaaagctgaaatctcttgtgaaataactagtaaaattatacctgaatatgtttttggctctgctcatgtcgaatcacaggggattttttttcctaaattagctcatatagataattctttccataaggatattgttagaacttcagtttctactggaaataacctaacttcagataattttcttcttcctgttcttaaaaaaggaaaaaaatgccaagcaaatatgattactgacattattacattctagagtgctttaaattgtcctaacagattggtagcctaattttttcacctttctccatatgcacgttttcaatcctggttaaaaattgttatatgtacccaagaagccagttgtatggtatttggaataaatattaatatttacttgttgcctttataattaatacagcttttgaaggatatttctcttgtatgaaattcccccttctctaacatcatatgtccagacagggcagagtttcatctgcgagtcctatcaccttgtggccacctgttgctggcgtctccacttccctctgatgggctcctggagcctgggcagcagcagcctgagagacagagagagttgctttgactgtgactgcaggtttcctgaggtcaaaattgggaatttggaaggccttagttgctcaggttttatctaattaaaagagtttaggaactcccatgtagaatgtcaattttctcttcagaatatgatgaaatattcatagtgtttacatttttttgtttttagcagcagtatttgcagaagtgtaattctaatgaaccttgtcacagctgtttgctcatttattttactgttattgcaaaagataagttatactctgtgctttttcagcatccttcaccaatttatcactttccctcttaaaaaatgtccaagtgttttccagtagaaggaaatactaggcttagagataggagataataattttacatcccatctatgtaatgttggttacatagtagttttacctccctggatcttcattttttaagctagtaaatagaaataatgcaatcatatttaacacatgaggttattatgatgattaactgagatgatgatgatggggaaaaaaatctgatatttttagagtatttaacagtttttaaagcactcatacattcttgtgatagtcaaaacgactctttactgcatgcaaatattatgttacttttagtgtcactgttgcatactatttctgtaaacatagaagtgaggtaaggtttcattataacttatgcatcttttcttttgcagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaagtaggtgaatgcaataaaaataacaaggttacactataaatgtatacttcgtatccagcttaagaatttcagatatgtttctaatttctcagagttaacactacattacaaactaaaaccagtactactacaaactactacaaaccaagaaaatggcccaaacgaaaaagactaagcatgcttgaggaagcagagcatctggaacactcatatagtacccattggaatgtgaattggtaccaccaccactttggaaatgaaagtagcattccatgggaagaatggtacttagtcagctgtgagctgtccatgtatgacttaaagccattttaaaataccagatcatttttcttttcccacagttaccattttttgctttatttccatttgttttatcctcagggattatacactgatttaataaaattgtagttaggaaagtaagtctactaaaaaaataagaggtattccaaagccaaatttgttaggtgattcctatttaaaactctttgttctatgcagtagcatttacctgtacatcataatcagtgaactgaagaggggaggtatgagaaaggagccatacagaaatatataaaacttaaaaaggaaccagggaagtgaaatatcaagtcctgtggcaattaaggttagctcttgttcaatttgaaagaatattggtacatgactgaaggctcttcgttctgcttgaatctaaaattccgagagagaagttttgaggtcagcttccattgcctctttgcaaccttaaccacattgttgaaaactgtgtcacatttccactttaccgataacttttccctgctcatttggaaggtcctgacaacagaacgtttttctttctcatctttgcctacaaattctactatatctcctttttgcttctctctctaatgctgtgggattttttttttctacttttcaaagaaagaaacctgagcaggtgtggaggcttatgcctataatcccaggactttggggggccaaggcaagaggatcacttgaggccaagagtttgagaccagcctgggcaaaactgggtgaccccatctctacaaaaaataaaaatatttgccgggcatggtggtatgcatcttgaagtcccagctaatttggaggttgaggtgggaatatcatttgagcccaggagttcaaggctgcggtgagctatgatcacaccactgcactccagcctcggtgatagagcaagaccttgtatcaaaaagaaaaaaagaaaccaaaccctgaagtagagccaagcaaatgaacaatggatggttatagtttatacttgacccattagaaaaacattgtttatttaggagaaaaaaggacattaccagaggcattatttgtagctgctaattatcacattgacttccttgtaatatttataaaatcacttgaattctctgctttcgtttgtctctctcagtggtagcataacttaccacctactttccctcccccctgcctataattatgctgttgatcatgcaattattaaataatcaaattatattctaggaatatagttatttctgaaacattttaagaagaacctaatgtctatagcttctgacttaaaaattctatcttaggaatctctgaaggacatcaaaatcacataatttttaattgagaaatagtagacacaacctaaatctccaattaagtaaactgtggtacaagcagacagtgaaatatcatcctgccactaaaaatggtttctgaaaaataatgatgtgggaaaatacaaataattaaatgaaataaaaagaattactaagtttgatctcaagaaacactagaaaatatccttcatatggctctgagtgttggaattgtggtgatgtttctgtatacatttctaaatttttcgagttttctacaatatgcctatattatatagaatttcctaagatgaattaaaaataaaaaaggctaaagcatagaataaccttccccaaacacacaaggattttaaatgaattgaaatttcctcatactagtaattttgtgctttttttttacagatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgcgtgtgtgtgtatatatatatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcataatgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagctagaaaaatatattcctaaggaaagtgagatttgaggagtccctgttgttctgcaacatccctagattgaatgatctgttgcagatggtggataccaagttcaaatttaaagatttctttgtaagcagtaaagtgactttcacttatttaacttagaactggaaaaagtaacttttttccagattacattttctgtatatttgtaaaatgcaaaagcaatatatatttgttgtgagaaaattagaatatacagataaaataaaatttaaaaaaacacccaaagataaccagaagaaaatttttgctatgtaacctttttcttctggtctttgcaaatcctgccgtagaaactttttaacttcaggagtgtccttcctttgctctattaggacattacagaaaccaatactatgaaaagctgacagcagtatctggattaactttttaaaaacaatgaaagcattttacagaaattacatttcagatcgtgctggaactgtgttcagaagatatcctcagagggaatctggcctgagcaccatcatgtttaattgcctcctcctgtcttgcattttcctcccagcccccttcctaccccttagcagagggccaggtgagggtgcttggggcccatgggggctgggagtgtagacttcagttacacccccagcccccaggggaaagcattagccttgaatcctcaatcccaggccctctactaaccactctcaacctatggtatttatcttttgattattctgtgcatctataaaaatgggattatattgtacagaatgctttgtaagctttctctccccacataagaatgccctgtaagcattttgttaaatatttttaatgactttagagtccaactttatactcctctttacgcattttggttttctaatttaatggtagtgtaaacgtttttggaataaacattcctgtggctaaatctttgcatacttcttgtattattactttaagatgtttctaagaagtagaatgactgaatcaaagagtgaacattttaaaatatcttaaaatatacatttggtaaataatgtatacactgtagaaaaactggaaaatagatgagcagacagaataaaatgtaaattacctgtagtcacctcatccattattcactttttgattttaatcatcctggcctttcacatgtatgtgtgatttttcagtcatacagtgaaacacttccagttctgtctcctttatctgatgctttcatgctctggatcttaaaacctggccagtcatttccccagtgatggatgctgagtgtcagcaacagctctaggtaagttggcaaccatgacatgtatgggctaaggcttgcaaggcttctctggccacacagaatccaattgcagtcagagcagaaacagaagccaaggcgatgcagtgggatcccagtttcacagtgaccatccattggtcactgtgaccagtcacgatagcctccacatccaaaaagtgatttcagtctttggttatgtatagtgaacaacacctgcacatttatctccactgtctcctgaaactccactaaaatagtagtaaagaaatagggctgggtgtggtggctcatgcctgtaatcccagcactttgggaggctgagaccaggggatcacttgagtgagggcaacatagggagtttgagggtaacatagggagaccactgtctttcaaaaaaaaaaaaaaaaaaagaaaagacttaagtccttcaagacagggaggacaggagaggtgctgaaagcagacaggacaggttagaatttggaaaatagaaagcaggtgggcaagtggtaaagtggcattaagcatgggctgtgtgttgaagtgctagatccacgactgagttcgagcaagttagttaactctccatgtcatgataaattagaggaaatattatcataatacctacccacagagttgaaaggagtaacagataacactccacgttaattgcataggacaatgcctgactgagttggtgctcagtaaatagcagccattatatgtattataactgttgctgttccagagagatctgagacctcagccagaagcaggggaagctaaaaagtgcaaatcaactcaactggcctcccatggaaggtaaggtaccacatggaaacagcaagaccctgcgggaagtatccccagccaactcccagaactcaagttgtcaggctcacaccatcaggcaggaaagtggaggcttcccctctaggaaaagaccccttcccacaaaaaaaagacctacggatactgacatttaggaatcaacagaataggtcctctcccacgcctctcagtcagcaagtaccacctacccacgtagtttctagttaacatcgtagtggctccttcttggctatcaatggacaagcaaggaacaccaagtatttgaagacaaagtctaaatgagtgacagagaatcagactttttaaataagcagagaaaggggacatgatggaaataaaaaaatgcaggtagtagaagaaatctgaaaaacaaaattctatttcttcaaagacatggaagaagaaacaagaacaaaaggctatgaggaaacattggaagtcagagcctttgaataatacttaatgtgatagtgaaatatgtttaaatgtcagatgacacatagaatgtcaaagctggaagtttccctagaagtcacttactgaccaactatccccatgtggaggtgaggaaatgggggctcatgaagggtgaagttgtttgcctcaggtggtataaccaggaccctcacaaattaaaggcgtgtattcatgcagagggcctggcagttgtaagcactcagtaaattctagtcttaataatgtttattaagaacttagatgttactgcatgatcttacttatttgtaaaatctaaaaaagtcaaactgatagaagagagtagagtggtggttaccaggggctggagggaagggtggatggggaaagcagagatattagttcaagggtatgtaaagtttcagctaggaggaatacattctagtgatctgtggcataacatggtcactgtagttattaacaatgcatatgtttaaatggccaaaagagcatattttaaatgttctcaccacaaagaaaggataagtatatgaggtgatagatacgttaattagtctgatttgctcattttgcaatgtgtacatgtatcaaaacatcacattgtactccacaaacatgtaccattatttgttaatttaaaaatgcagagaatcaagaacttatatgttcaacctgggcaacatagacctcatctctagaaaaaataaaaacaaaattggccaggcatggtggtacgtgcctggagtcccagctattcagaagcccgagaagtggaggctgcagcgagccaagatcacgccactgcactctagcctgggtgacagagtaaaccctgttttcaaaagaaagaaagaaagaaattatatgcaagtaataataaagttgtttaaaaactttgagagattatgtgttaagtatggggcagaaggccttcttttatatggattatctcatttgtgctcacaacacacaggtattattgttcctattttataaataagaaatttcaggttaagagagtttaaataaacttgtcaagctcatcctggttactgagtagtggagcaaggctaactccagaatgctttctcatagccagagccaggagtagagtccagttctaaagaaataacatcaaaactccaatatgttacaattcccactggagcttagaccagcgctgcccactagaaatataatttgaaccacatatgtaatttttaagtttctagagccatttttttattaaaaaggtgaagttaattttaataatttattttaatccagtactatccaaaacagtatcattttgacacgtactcaatataaaaattactaatgggatttttttacactttaaaaaattctaaatctttggaatctggagtgtaatttacacttccagcacacttctactggcttagccatgttccaagtgctcatagccacatgtgaccagtgactactgtaatggacagcgcagccatcaaccaaggggtacatcataagaaagagagtcaatggatggtgtgtgtcaagttcaacctcacagtttctctccttgtgtaattggcatagggataggtaagccgagcagggagctaatacccaattaattgttaggctcagtacctatgtatacttctcctgattccaccagaaggtgtcccttgtctgtctccaaaatattccacattgcctctatcccagcagttatcacattccattttaattctgtttttacatgcgaatgccctccatcaaactgtggttgaggacagggtccatttcttttaaatctctgattccaaagcacctctctgttgtgaacatgagataaaaggatccctataaagcactggacacatttcatgggctcttgatgctctattggaagaaactaacaaaagcatccttttgtcactaggtgacactcttgtcccagcctttttgtttttgctcttattcttcatagtgttagggggagctgattttcacattcacaagaaaataggaacaccccagatctttctgactgactttcaaagctgcaagtgacaggatctaagatttaaggtgtatattcaaacagaaatgccatttttgtgacagtgccctaactcctgccatgccaactcttcagcaagtagcccagaaatctcagttttcttggccattgttttttttttttttttttttttttaatctggccagtttgtcctggctgcatgaggaaattgaatatcctgatttggaatgaataggaaagggatcctgggatagtatctgaggttggggttgttgagatccagaagaggggccaacctgtccccatttgacaagcaagtggcctgatttgtgactctcttgagaggcccacagcccctcttgctgtggtctaatgctcagtgcagagtttttgggggatcactgttaaatccactcaaggcttccatatttgcaccttcttcttatgaatccagtaaatatctagcagcagaattgagattcagaaaactgtgcaagactatcctaagaatgctggccaattctggacatggtgtgcatgtgtgtgtatggtagattgaagaaggatagtgtggagattgcataagcagcataggcttcttttgctgaaatggcttttctgtgcagactaacttttcctcaagtcctggaaatacatccagcccaatttattgtattcaggccaaaggagcagtaagttgaaacctgctctataagtagggtgatcaaatagtcaatttattgtcaaaatcaggacactttttagaggaaagagtagtgttttttttgtaattgcactggaacagcaagcataaatcgggaggctcctgagcgaactgggatggatggtcactatactcaaggcatggccagtgccctacatttggctttttgtcagatgtaactcagaatgaaggttatccattcttttctggctatttttcttcctctatagaagagaagaaaataccagcggtgtttcctagtgtgtgacgagtagagtgacgattagacctcactaatttccatgattttaccaggaaaaccactttgcagaagggtccaatgtatctgttgccctgcactggattctgaagtccctcggaatgctcactgacttctgcatttggctaacagaggctttagtaccaggaattcccaacagcttaaaaaagtgaatccatatcagataacagtttctacttttctcatgatctgttctttattcccatctgatttctttaatgactagctaatttcctccaggcctggacctataatcccaaattaatgtggacagttgcagagagatatctttctttgccttatagtttgtatgtctttgaagtgtgtagctaaaagcaaagtctcctctctttgcttgttccttcatccccaacaggggtgtgtacctctgcactatctcctagaggagtggatgtattttgagcactgcgatataaagagccaactgcatggtgtggtgcaaagaccacaaactgggtcagaagacatgagctcagtgaacctagcacagatcctgaccctagcagatactcagtaaatgtgagctgattcccaatcagatcattatagttaaccattgcagtggagggaagacttctgtggcttctaccaacactgtgtcagaggagttctttgcctgggtgcccccaattcaaacctagtagatgctaggaccattcagagcaagtgagaactaccaacactgaggcctctacagatctttcagctttggatctttcagctttggagcctttaaatcttaaacatgattcctttaggtccctggggacctgaataagaaagaatcatattctacccagacatgaacgagtaaggccttcctctaactcagaatttgacaggagaagtagggaagtatcataaaacagtggacagaatccggactttggggttagatagccctgggtttttagttgtttttgtttgttttttttggagatggggtctcaccctgtcgcccaggctggaatgcagtggcgtggcctcctgagttgaagggattctcttgcctcagctcctgagtagctgggactagaggggcaccatgccccgctaattttttggtatttttagtagagatgcggtttcaccatattggccaggctggtcttgaactcctgacctcaggtgatctgcctgcctcagcctcccaaagtgctgggattacaggcatgagccactatgcctagccagccctgagtttgaacacccacccttaccagcatctacttagtcaaagtcacttaccacctggagcctcatttgtaaactggggataatgaaaactacctgcagggttgctatggcaataaatactacagatgttaggtcccagcacataataggctctccatatggaatctattattatctaaaaggacagtaacacttagggtcagttgagaaaatagctctgtactaagaagggaccaatgactgggagatgccagaaagcagactctaaaatcataaatctcaaaacaacaaccctaagactgtacttgtgagccatttcaactatgtagtttataggagcaatccctttacactacagcaagttaagcttcaacttaaatcaatggctgggcttgatccattggtagtggttgtctgaagtgctggttaagaaatattctgctgctgagtcaactcagtagggatgcgtgccatggctgactgatcagcgatgcctgctctgggcacaggattgggaagcagaggcaagtatgccaaatagttaccctgtgttcctcacccaccagcggatgagactgcccttaatacaggaaagaatttgcaagtctagagtagcactcaggctttgggtagcttaggggaaataaatgaaaggtagtgatgcgccaaagactgatgcaaataggaaggtttgggagattgtgggaaatcttgatagtatgtaggcaaatttcaatgatttcctaaccctacccaggagcagccccacaacagtagtcaaaagggcctgagcaattgcctctaagagccaagagaaaattctgaatattgggaaaccctaagtcagtccacagagcctgagttaaagtgcaggaggagatgggaagcacaacagagtataaggtaaaattaaagcaaatgcccaaccttgtctttggaaacattcgattaagaagcagtagcttgggccgggcgcgatggctcacacctataatcccagcactttaggccgaggctggtggatcacctgaggtcaagagttagaaaccagcctggccaacatggtgaaatcccgtctctactaaaaaataaaaaaattagctgggtgtggtggcgcatacctgtaatcccagcaacttgggaggctgacgcaggagaatcgcttgaacctgggaggcagaggttgcagtgagccaagatcatgtcattgcactccaacctgggcaacaagagcgaaactccatctcaaaaaaacaaacaaacaaacagaaaaacactagcttggaaacagccaaaatggtcgagagcaagaaagccttaaatgtcccacaaagtaatgctccttccaaaaatctaatggccttcctgtaattgctgaatgacgtctcaatacatctgttttgagagctctaatcttgagcagaattgagtaagaaaaagtacagcctgtttctttcttaatgatagagtagaaaagatgacctttatagaggtcatggagattataaatagcaaattcctattcctagccctgcgtgccccctgccccaactcaacaagaaatagcagcatttgaagcagaccttctgagttaggaaaaataatcctgaagaacttgaagagtcaggagaaaagtaaagatcaagagccttaactttaagaaagaacaagttttggaacaggctcttcttctcctaccaagactgtcattaagcaggtttctcttgacgtgagaacagctgctcatgtggccactttgttgcttgtaccctgagggccagctgcatgaaggggcatggtacagctctccccctaatctttttaagtttttttttttttttgtaaatctttttaattttggtaccattcctactgaagtctttctgagacagccaatattcttttgtcttttcttcctacattttccaatggcacagcagactgggaagcacctgtgagtttttcacattttttggcaaacattaatatatcaattctggcaaatgcagagaggcattaaaagaaatttggaattgcccataaacttaccatcagagataaccactgtttactttcactagcttagtatatatcattgactaatgggtgccccggtcatccttctccatacgtgctgtgggacattggtatgttaggaaggggttcttagtgtctccttgccactttctcaccaggagcagtactggcagggtttaggatgggggaggcagaggaaggggacaaaaacggtgatcactacaatgctgagaagtgggggaatggaaagtatttgtgagcatggtgtaaatttaatgcattatgcttatagatgtggcaacactaatggttgaatgggggaataatttggtgacagtcttctctgatgcattctggcaggtggagaagtatttcactgtttgagaaacattgtttttcacggtttaagaaacatctttcaaagcctaatttctttactcctcaggtgtcaagacctttgtttacaccagatcaattgtgcaaagttccctgcaacctagaaatgaagcaattatttcaaatctatttatgggacacagaggacacacagtgagattttgctgatagtgcctttaaatctgaaccttgggtcccacccctctgccaggccacgtttgtctaggtaggcagtgactgcccaatttacctggattggtaggggtgatgggggaatacagaggaagaaagactcattagatgctgttctaagattagctctagttcctgatcattggaacagtctttggaattctctgctcagtcctgggaagatgttgtcaaggggataattgtcagaatggtgcaaacactgcaggagaaacagtagatacactcaccaaaaagataaggaggtgttttctggaaagatggcccctttgcaattagtgactattcaaaattaaaactacctcctttcagttacccaagtaactgccattcataaatgcctgagttgtggttgcatttacccgtgtgcagagaaactgaccacaagactttcaggactcagaggactgaattgaggggtggctgcctctcaatgaggagtcagaggagcagggtgtcttcctcaggactcaccaggaacaataggacccatgtgatgagattgggcccacctggacaatccgggctagccttcccatctgaaggtcctcaatgtaatcacatctataaagtctcttctgccacgtaaggttttgtcacaggttctagtggttaggatgtggacatctttgagggaccatcattctgcctaccatagccatgacttcctgggtatagcaacactgctcaaactctatgcctccacttctagggatctggacacaggtcatgagctcagagtttttagaagatggtgtcactagggtaggtattaatattaacctcagcacaataccagcagtttggcacccatgattatcccagcaagcttcagacatctagtcttccttcaggcatctgtagacatttgcattttggcacttccatcagctcccaaaccctttcctctggctggctcagaaatacctagcgccatgcttgaccctctggtagggaggtctaaagaaaggtccacccccattttatcccttcccctcactttccaccacagataacaacccagatggatgcagctggtgtgtcttcctgttgacaaacaccatggggagtgagttgtgccaattctcttgccacatccacgttatgtctcccctgactcctctgtaactccctccctccaattctctcctcatgacaaaaaacctgggactgcagactggcttatgaaaaatgtggataacaatgtgcaaacagatgggtgtggtggtttatgcctgtaatcccagcactctgggaggccaaggtgggcagatcactggagcctaggagtttgaaaccagcctgggcaacatagcgaaacactgtctgtacaaaaaatacaaaaattagctggccacagtgatgcccacctatagtcccagctactcaggaggccaaggtgagaagattgcttcagcccaggaggttgaagtggcagtgagtggtgatcacaccattacactccagcccgagtgacagagcaagactctgtctcaaaaataaaataaataatgtgcaaacactcacacagcattttctatgtgctaagtgcattattcacattaactcattgaatcattgcagcatccctgtaaagtgggtgttatcaccttttcttaaaagtgaggaaactaaggcacagagatatttagtaacttacccaatgagtggttatgatgggattcacatctaggtaggctggctccagagcctacactctgtccccaatgctagcgtgcctctagacaaatatagatccaatgataatattcagaccatcactgggaggtgaagtgctttctcctaccttcctagatgtatttgcagttttaaaaagcacagagagtgatgctatgtgtcacacgagtacaccctgcccaagggagatggattcagactgggagcccatgggtaaaggtttgttctggttctgccattttgctggctgaatgattgtagacaaataatagatcatctctgagtctcaatttctttatctgcagaacgaggatgacagtcacaataccaagctcacaaggttctggtggggaatgacattcctgatctcattggataaaagtgttaaagtattattcactacctagagctaaggtcatttgttttctttttgttgagacagagtctcactctgtcacctagtctggagtgcagtggtgtgatcacatctcactgcagccttgacctagctaaggtagtattcttattagagcatgggattcaagcttgttgagcatgaatctgagacagagagcttgttggccctccaagcacagcactgggcagcctctgttccttctgcatataaggccacctctttattttcattcactgccactgactgggtcaggacctcaccacctctagcttgaacctataaaacagtttcctatcagatattcttcctgtactctcgccccttcccaatcaaaacgctggcatcaggttagtctgaggcacaaccttcctctgttatccacaagttgtgaccttctaaactttctacagcctgctgtctctggcaagggtgatgaactcaaacacctgtgaaggtccagaggacaccacaagtgagtgaggtggaccaggtgtgcaggcagtggcaagccagaccctgtgtctcttgcctgaaagggaagcggctactcagcttccgttcgaagattctctataaggcctgaccttcctatttttaaagagaagctggaaatccatgttgtttgtgaaatgttgtatgcttaaccaaactcaagtttaaaaggaaaaaaataaaaacacgatacaggtcaaacaaaagccatctgcaggatgagtggaatcggccaatttttgacccttggtatgcaggttaaagcccaaataataaactttgcattctaggtctgtacaggtttgacactaacctacctttccagctcgcctcctgctcctcctccaggtctgctcctagccaagaatagttctggttcccaggacacccaaagcccctccctacccctgcccctttgctctgctggcatctggaatgctctttctctcaccttccccaccctccagctcctcctggaagttctactattcctcctggaggctttccacagtttaactccagccaatgaatgattaaataattacacacaatctactccccctgggcctccagggcactctcaaagagctctgtttcacctgtgtttactttctaccacatcctggccagtgccacacctcagaaggcttcagagaaaaattgtgactaactgacttgtgtcacttctctcctactaaatcataagcaagttgtctgcagagccccccactgccagctccttgccccagctcctcccaccaccaccatgacccaggacagcgccttataggtcccagatgactgtcaaggcttcttgaaagctttggctctaagggattaaactggaagactgcagctgattaactcactaggtttaaattaagttcttgggcttgctgcaagcagagcaaaactctcccgtctctctgcagccccttctcaggcctctgctctctttgtgggcatggccagtgtctcttagctgcatcctgggtcactcaaggtctcagggtaggagagctggatgtacaaatcacaccctcatcctcctgggggagtggatccaggtgctggtggagggatgccagcatcacctggaagcagaaagttatgccctgagggagctgtcccttgtttgactaatccaaattaataccactattattgtcttacagtgttagggccatgagaggccatatagccatttagactgaaggaggaaaccgagacccagagaagcatgatttgcccaaagacagggtaagggtgaactctagataggatccaggacatctaactccaactctggagacttttttccactaagccaaagatttgctgctatcatttgaagtgttctgataaaaacacaagtgagatatctcaagactacatttttcagacactccatctcacagctgtgcaaaaatgggctgccgatttgtttttgtcctttctgcttctgtgaatgtggcatttggagtgtgacatttgctgctccagccacttctgatctcagtgtaatttccttagcttaggaagatgcgtggtatgtgtctgtgtgcttgtccctacatttcaaactccctggagaacatgtgtcgcagaagtagacaaaatgagaaaataatcactggtagtttgctgcaatgtctcttggtctgttctctttctcaaccttcctaagtttgtagttgggacagacttctgcaacaaaggacagattaacaagagaacagtccagcttatcaacacgtacaggacacatcgcgtgggagaaacctcagtgaagagttaactcaaggcagtgtttacgagtctgccatatatagtatgtctaataaagaacaataaatttcagagaagtgacaagacaaaggaaagtagtcctggacttccaaaaatgggaagctatgggaaggtaaatatatgggcaaacactaatggagtaaagtctgctcacaggtccctctggcaccatctctgagctgatcaagggttgtctccagtaatgaagaatgtacatcttatctttaggtaagaaaagagacagggaggataaaaaaccttttgtctctgtaaatctctgtcctgcttttaggcaagcaaagggaagacacagagctcccctgcatcttaattatcttcagctcaacaatcctcttattttgaggaggcatattctggtctcccacagttgccatatttccctgggaacattcaaacgaggaatagctgccatgaaagtcaagaaaagacattttgggagcctctccaaacctattctgggtcagaggctgcctggtttaagaaaaaagggagagagaaaaaaggaaaagatagtttacacttacactactttttcaaaataagagattattctgtttattctcatgcccatgatgggaatctctgctgaagagtaagtcaatggaggaaggcatctattgaagcgctaagacaagatcattaccttcattttacagataaggaaactgaggctcagggcaactcaaactaagcacctactatgtgcaggttgtgttttaaggactctatatttatttacccagttaagatttacagtaacactatgaggctagtgctagtatcatcactcccattgtacaagtgataaactgtggttcagaaagaactaatattcccaggagcatttagttcatagcttgacaaagccaggatttggacccaggtggttgtactcaaagctgatgttcaaaatcattcatctgttaatttttagtcaaatgaatgggccaggcactgtgctaggttctgcagatacaaaagtgagtgaaatagacacagttcctgccttcaaagtgcctccagcctagcaggaaagagactgtcaataaattatataaaactgaaagggatcagagtgtattgccttagtaaaaggattgttttgagctgaaggcaactgggaaagagcagactgcagaaaggctctctacttttccctatttgcttaaaagcagggcatatatttttctttgtgaaggtgttccccttccctctctcataccaggaaaggcagaataactcttagtcaccagagataactctagactcttttcatcccaaagatgaccccaaaaggaatctataacacaaaccctactaaaataacacttaccttccattagcttccccatatatttaccttctcacaacttcctgcctctagaagctcaactgccttttcatttgtcttgttagttctccagaaattcatcgccctttgttaaaatggtatatacacctccaactctgactatgtctttgggattttcatttcatttctctgaggtaccttacatgcccatgaaataaacttttttctcctgtaattatggcttttgtcaatttaatttccagggccacagctgcagaattgaaaagcatagagaaaaaagttttttccctcccctacaaaatctcctggcacttaatcctatgccctttctagttcatgatgttgatatcacactcctgagtcagcagtgaatgacatttccgagattgtttgttccatcctcaatcctcatgtgctccttttacccaaacctgaccttctcaccactctgtctgccttcctaaatgggctttattttgtgaggtgaggcttgagatc

SEQ ID NO: 1176 - DNA, 1102 bp, Homo sapiens
gcgtcgacgtcttgccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccattgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacaatcatccccatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaa

SEQ ID NO: 1177 - DNA, 8608 bp, Homo sapiens
cagccccggcaggatggcggcggacacgcaggtttccgagacactaaagcgttttgcagggaaggtgacaacagccagtgtaaaggaacggagagaaatcctcagtgaacttgggaagtgtgttgctggaaaagatcttccagagggagcagtgaaggggctctgcaaattgttctgcttgactctgcatcgatatagagatgcagcctcccgcagggccttgcaggcagccatccagcagttggctgaggcccagccagaagccactgctaagaaccttctacactctctgcagtcttctggtataggctccaaagcaggtgttcccagtaagagcagtggctctgccgccttgctggccttgacctggacctgcctcctggtgcgcattgtctttccatcgagagccaagcgacaaggagacatctggaacaaactggtggaagtgcagtgcctgctcttgctggaggtgctgggtggctcccacaagcacgccgtggatggtgctgtgaagaaactcacgaagctgtggaaagagaaccccgggctggtggaacagtacttgtcagccattctcagcctagagcccaaccagaactatgctggcatgctggggctgctggtgcagttctgcacgagtcacaaggagatggacgtggtcagtcagcacaagagcgccctactggacttttacatgaagaacatcctgatgagcaaagtcaagcctccgaagtacctgttggatagctgtgcccctctgctccgatacctgtcccactcagaatttaaggatctgatactgcccaccatacagaagtccttactgaggagtccagagaatgttattgaaactatttctagtctgctggcatcagtgacgcttgacttcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcaccgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctacgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcgtatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatctt

SEQ ID NO: 1178 - DNA, 696 bp, Homo sapiens
aaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggcactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtcccg

SEQ ID NO: 1179 - DNA, 1225 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccat

SEQ ID NO: 1180 - DNA, 8747 bp, Homo sapiens
caattctgaatcctgccttttgcacttaatgtttcataagtatttccccatgtcactaaaaattcttccaaataacattcacgatgtccatatggaatttcagatgtggatgaaccaaaatcttgtcaactattccactaacagtggttatttagggatgttcagacatttcactatttaaaaaaaaatgtttccacaaatacctttgtggcataagtttttatgagtggagttactgttctgaagttcctgctgaatagaaaatgctttccagtgaggctgtcccaagccacattcccatcagtgacaagcgagagacagctggtcttttcaaatccggagaccaaatattatctttgaaaaaaaatggatttttgcctaatttggtagtcaccaaatagcatctcattgttcttttaattatctgcttccttttagtagagatccctaaaaagatctgaaaggagtcttcagataaaggaaggagctttcttttgtctgtctacaatcaacaaatatttattatgcaaaccattttgctccgagttttctcctctttccctttttggacagatttgggagatctcacctttcaggttttagacatcgtgcagggaggagttttgaggtagggtgcagcttacggtccaggataaaacatactgattctgccactaccaggctttgtgaaaagcaagtcatgaaaacgctctgaaattctagaccttcagtagataggatctaccgtgtctataaaaatatgaagatccttaagttttattaaagattcgaaaaaagtaaaagtgtttttacggttttattttcatttttatttcttaccgttatcgtttattataaaggatattataaaggatacagatgaagagatacgtaatgcaaggcctgtgagaaggggcgtggagcttccgaaacctcttccagccaccaccctccaagaacctggagtttctttttttttttttaattctacaaatgtaatattagaattgattttatctggccattagtgtgtgtcctaactcgttcgtttctgagagtcccatctcccggcccgggatatcatctttcctgtgtcagtgaaagtgcagagtagatgagaacctttaaccaccaacattagggaggggtcccagacaaagggggtaagtcatgctctgtagagaaaaggttccctgcctccgaactacctctggaacactccagtaaatgtttcctcttttgatatagaaaagagggatcgtgtgtagagtgcagtctgggcaatccctctcctcgggaccatttcggggtaggggcctctggggtccgtgtcgcgacgcacgcgcctcggtcccagctatctccgcagcgggccaccccgcctgcggacgcagtttctcggccccgccccacactcgctcccccgccccacccagtctccgcgccggagggaagtggcgcgagggggaaagcactgtctgcgcgcccactgcaaacctcagccagtctgagatcgctttaaacgtctgacccccacccccactccgccccgcccagttcttcaacctaatttctgattcgtgccaaagcttgtcctctgctcaaaatcgtggaagacgccgagtatggggaccgaagacctgggttcaagcccggcttggaatccctgcccatccctggcatttcatctctccgggcttatttgctggtttctccgaatgcgggccttgtctggttcacgctggatccccaacgcctagaacagtgcgtggcacgcagttcgtccttctataaatatcggactaaatgcatctctgtgatggtaatacccacacggtgttgtgagaatgaatgagtgattctgtgcaagttcctagtgatctgttacaaaaagtactggtcgctaaattactcttataataaagcatacttttaggataataaagcactattcgcgaattggttaccgctattatgaaattactgagcaatacatatctacatctgatcagtctccagaattatgccaaatcctaccttcttctgaaagtatctcctaattatctgcacctgaccctagtgatgctgtgaatgtgcaagtatagctacatcctccgaaggaaaggatctttactccttttacctcctgaatgggctgcgtctgctgaaagcgcgggggaatgggcggttggaagcttggccctacttccagcattgccgcctactggttgggttactccagcaagtcactccccttccctgggcctcagtgtctctactgtagcattcccaggtctggaattccatccactttagcaaggatggacgcgccacagagagacgcgttcctagcccgcgcttcccacctgtcttcaggcgcatcccgcttccctcaaacttaggaaatgcctctgggaggtcctgtccggctccggactcactaccgaccacccgcaaacagcagggtcccctgggcttcccaagccgcgcacctctccgccccgcccctgcgccctccttcctcgcgtctgcccctctcccccaccccgccttctccctccccgccccagcggcgcatgcgccgcgctcggagcgtgtttttataaaagtccggccgcggccagaaacttcagtttgttggctgcggcagcaggtagcaaagtgacgccgagggcctgagtgctccagtagccaccgcatctggagaaccagcggttaccatggaggggatcagtgtaagtccagtttcaacctgctttgtcataaatgtacaaacgtttgaacttagagcgcagcccctctccgagcgggcagaagcggccaggacattggaggtacccgtactccaaaaaagggtcaccgaaaggagttttcttgaccatgcctatatagtgcgggtgggtggggggggagcaggattggaatctttttctctgtgagtcgaggagaaacgactggaaagagcgttccagtggctgcatgtgtctcccccttgagtcccgccgcgcgcggcggcttgcacgctgtttgcaaacgtaagaacattctgtgcacaagtgcagagaaggcgtgcgcgctgcctcgggactcagaccaccggtctcttccttggggaagcggggatgtcttggagcgagttacattgtctgaatttagaggcggagggcggcgtgcctgggctgagttcccaggaggagattgcgcccgctttaacttcggggttaagcgcctggtgactgttcttgacactgggtgcgtgtttgttaaactctgtgcggccgacggagctgtgccagtctcccagcacagtaggcagagggcgggagaggcgggtggacccaccgcgccgatcctctgaggggatcgagtggtggcagcagctaggagttgatccgcccgcgcgctttgggtttgagggggaaaccttcccgccgtccgaagcgcgcctcttccccacggccgcgagtgggtcctgcagttcgagagtttggggtcgtgcagaggtcagcggagtggtttgacctcccctttgacaccgcgcagctgccagccctgagatttgcgctccggggataggagcgggtacggggtgaggggcgggggcggttaagaccgcacctgggctgccaggtcgccgccgcgaagactggcaggtgcaagtggggaaaccgtttggctctctccgagtccagttgtgatgtttaaccgtcggtggtttccagaaaccttttgaaaccctcttgctagggagtttttggtttcctgcagcggcgcgcaattcaaagacgctcgcggcggagccgcccagtcgctccccagcaccctgtgggacagagcctggcgtgtcgcccagcggagcccctgcagcgctgcttgcgggcggttggcgtgggtgtagtgggcagccgcggcggcccggggctggacgacccggccccccgcgtgcccaccgcctggaggcttccagctgcccacctccggccgggttaactggatcagtggcggggtaatgggaaaccacccgggagagtgaggaaatgaaacttggggcgaggaccacgggtgcagaccccgttaccttctccacccaggaaaatgccccgctccctaacgtcccaaacgcgccaagtgataaacacgaggatggcaagagacccacacaccggaggagcgcccgcttgggggaggaggtgccgtttgttcattttctgacactcccgcccaatataccccaagcaccgaagggccttcgttttaagaccgcattctctttacccactacaagttgcttgaagcccagaatggtttgtatttaggcaggcgtgggaaaattaagtttttgcgccttaggagaatgagtctttgcaacgcccccgccctccccccgtgatcctcccttctcccctcttccctccctgggcgaaaaacttcttacaaaaagttaatcactgcccctcctagcagcacccaccccaccccccacgccgcctgggagtggcctctttgtgtgtattttttttttcctcctaaggaaggttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaaatttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatttacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatgttctgatttctgttgacattcttttggctagtagaagacaaaagtaatacatttatggtatgcaaagcactatcctaggtatttcattgtaatattttacttaccccttatcacaactctgatagattctgcttctgttactaattacattttatagaagaggaaacggaggcacagaaagcctaagtaacttggttaaaggcatgtagtaagtatcaaatcctgtattttaaaccaggtaacatgacttaacgaatctgaagccttcaccactttaaattcaaatggaagtttagaaatggccagccagcacctatttgtatgaaaggtcatctttcagaggataagcatgtataaagaagaaaaggtatgcagtcgtgtttggattttactccaccatccacttgtgaaacccaggtctgtgcaatgccagacggtgtgtgctttcctcatccagtatcctcagtgtagataaccatcactcccttttcacagacaagagaactgagattcagagactttccatacattgcactttcaagggggcaaagccaagaactaattctgtttattgttccagctcttgctcttaactcttacctactattgcccttcagaacacctgggcataagtcaactgaactgctaataaagaaagccaaaagtgaatgttttcttcataaaattaaccatgaccaaaatactcctcttgtaatatcttctatgcaaatctcaacacttttattcttaaactatcgcaacacctagcacctcctcaaggactcagccaagcagctacaagttaatactgatatttgttagagtcagaaggaaggtccactgaagcaagctccctgttgctcacattttgcacaagattttggagacttatgtaaccacccgttgctattaacacgaccattgtgcaagccccaggctcttgagtaaatttcagctttggtttctatttaaagataatttctaaactctagccatacctacctcacattggaacacaaacagggtacactccaggcatgcactcagataataagtaggatataattacgacaatatttggtctacttttagtaattgtttctggcacagaaaatccattttggaggaaaaattgcaatgccttatctttctgaggcaaatcacatttgttcaaggcaaattatagatcctgtgaagggaaataacttaattacttaaaatagaatccaatttggctgtacatttttgctgccgtctatggatctggggtaattcaaagtggtattcatattctacttgaggacacaattagatttcagataggaaattatcttgaggtttcttggttttccctgagaagcctaattggatcacccttcatttaagcatagttttacatgcactctctcaaaggcttagtcttaaagccacaaccattgagacagacttcacttgaaccctctctataaatatttattctccgggagacaatagaagaaatccttggaaggcatgctttttctttctcatcttggcttgaaacctccttaccccagattcctctcctttaccgtggagtcacaacaaaaggaactgagccaaaacaaaattcccagtgtcaccagtcttaatggatatttcattctcccttggaacaaagatggaatagctttttttccaaaagaaaaacaagccttggctctctccctgccccaaaagggtgccccccacccccatcattctctgtcccaaccctgccatgttagagcgtctccaaagccttccctgtgtcgtggtttgtctgacaatgtggggaaacccagtctgctggccagcccttgcatgaagtagctgattgttccctctcctcatcccttatgaatggggcccttgaagttcagtcatgtagattcagttgtataatgaaagctaaaatatttaaattgtatgcatgctgccaataacagcatacatctgacatctaacttattaataacattaagcctgcaactaggggggaaagtggatgttttttcttgcaaagcctttgttttcctaaaatgacacttgaaaatttatctccccctactgcaggcttcccagcccccttttataattatgcttaaattaaaataatgattctgggatactcttttggggagataccctacaggctttattttaataattgaactaagtgtttgtgactttctcctagatattgtcaaatattaaataaaggctccataaacaattgagctgtcttattcccagataatacccatttaggaggggcaaggatcc

SEQ ID NO: 1181 - DNA, 570 bp, Homo sapiens
ttttaaaaatcagtcgggcaaaagtttttccctacattctactgtctgatgagattggagagcagcaagaacttgctgtcagcagtcattttacaaaaacagctcaggaggtgggtggcacctacatcatgttgtggtgattgttcctgtcaataatgtccacaggtgaaaggatttccttccggatagcaggggcaggcagggagagcgtcgtcttagtcttgaagaggtcagacacgaagaaaactatgcagcaggccaccagggctccttgagcaaatcctgccagaacatcactgggatggtgcttgtggtctgatacgcgagacagtcccgtgtagaaggccatcatgatcaaggtgaactgcaggaggggccggagcaggcgggctcctcgccaagtgaagcgggcctgcaggtatagcaccagatacagcatagtgtacatggagaaggaggcatggcagagaagaaggacttcctggctttctggactttgctgtcatcacctctgcatctgtagttctgaatgtagctttcaaagcattgaatctggctgaatacaggttt

SEQ ID NO: 1182 - DNA, 619 bp, Homo sapiens
aatgtgaagaggattaaagaataaagaaaaaacaaaaaagtcttatactaaaataagaaatcagccccatcttggcacagttctcatgcagaatattgcacccagtgtgaactaacgctagaagcttcaaactgtataaatttaaatgtatttgcatattataaaaataaagataaacatatacatattttacactagttatggaacagcaatgaacgtcagtcgatccctctttcacatttaacagaactgaaatctgagtgctctaaatactgccacctgtactgtaactatggcttatatgtgcacggaaaacaaaatccctgagaagccattcgacttttttttttttttttcttttcttcaagtagcgcgctccttggaggatcacagttctgaggttcaggttgtaaaacatttgctccatgttctcgtccatgcttccccccaccaccccctccccacctcttccccagtcatccaaaaagcaccctgcaagcacgcgttgtcactcaagttcacagaacacgctggggtgagtgcagagggtctgccaggtgcaaaagatggtccaggtgttcagatgctctcttttctccatggaaattccacagccaca

SEQ ID NO: 1183 - DNA, 711 bp, Homo sapiens
  misc_feature 386, 409, 417, 471, 472: n = A,T,C or G
ctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtnagcataaagcagagagaacccangttagaanggatggaagagaaaggagcagttttattgcttatagaaagccgtctgaagggtnngtgggtaagctcagtctattactgagacaatagtgagatgggctattatgttcccctggtaatatctgggtaaaatattgatccatcaaatgggatgctccgcacattagcaaaattaggagttcatctttttcattgaatacaagtggagacctccatttcctttctgtttcaggcctttgacccctggagcccattacaactcaataatttgatttatgattataaaggtccatttt

SEQ ID NO: 1184 - DNA, 895 bp, Homo sapiens
ttatttttctgtgtgtcccatacaggcccccaccatgaagggtttcacagccactctcttcctctggactctgatttttcccagctgcagtggaggcggcggtgggaaagcctggcccacacacgtggtctgtagcgacagcggcttggaagtgctctaccagagttgcgatccattacaagattttggcttttctgttgaaaagtgttccaagcaattaaaatcaaatatcaacattagatttggaattattctgagagaggacatcaaagagctttttcttgacctagctctcatgtctcaaggctcatctgttttgaatttctcctatcccatctgtgaggcggctctgcccaagttttctttctgtggaagaaggaaaggagagcagatttactatgctgggcctgtcaataatcctgaatttactattcctcagggagaataccaggttttgctggaactgtacactgaaaaacggtccaccgtggcctgtgccaatgctactatcatgtgctcctgactgtggcctgtagcaaaaatcacagccagctgcatctcgtgggacctccaagctcctctgactgaacctactgtgggaggagaagcagctgatgacagagagaggctctacaaagaagcgcccccaaagagtgcagctgctaattttagtcccaggaccagacatccccagactccacagatgtaatgaagtccccgaatgtatctgtttctaaggagcctcttggcagtccttaagcagtcttgagggtccatcctttttctctaattggtcgcctcccaccagactcacctgcttttcaactttttaggagtgcttcctcacagttaccaagaataaagaaagctggccaccataaaaaaaaaaaaaaaa

SEQ ID NO: 1185 - DNA, 465 bp, Homo sapiens
tttttttttgctgaaacatgcagagaatttttatttatcacgaatgttaatacttatattgacttgcagaacagagtgagagagacgtgcaggccaaggtattagtagggttcaagggtttagcaggacatctagtacacagtaggttgctcactaaggacttgtcatatcttgctcaaatgccaacttttggtacagcagattgtcaattagtcatttcttatagagatgcctttttggatagttgtcatactacatttctgccaattaaggatttcagtccatttttcgttttttcaatcatcgtttaaggtcaggtagcaggggccccatcccccctcccccctcagataacagaatagtattcttattagaagttcctaagaccgagcaattccagcatgcaaattgtgataggacatagccgggaagatgagaaactgtagccatcatctagggatatta

SEQ ID NO: 1186 - DNA, 553 bp, Homo sapiens
ttctgagtatttgctgtattttatttgttcacatttagcctatttgaggttaacactacttcatttgacagtttaaaaatcatcctgtaaatagaataaaaaacaacagcagcaatagctaaaaaaaggacacaatgtataataaaataaaggaatgtgttgaaagaaatattccaaagaagcaaaggaaatgagaccatgattatgaattcaacaatcagaagaaaaaatcgtccaacatctgtaaaaagcaaaatcataacagtaataaaaaagaagcaagaattcaaagtgcaggtgcgctagctttcatttccacatccattcaggaaatagagcatactattcttttatataaagtgacaagttctgttttaaaacattcagttacattatcttgcagattttttttcagtttacattatctctacattgatttgatggaaagatggtcatatgcgatatgtggtataaatttcttcaatctatggagaatacggaaatggtaaagttgactgttttacttatgtttttgcagtaagaagctaaacat

SEQ ID NO: 1187 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 1188 - DNA, 3676 bp, Homo sapiens
gagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccagggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaagaaaaaa

SEQ ID NO: 1189 - DNA, 2080 bp, Homo sapiens
ggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaaaaaaaaaa

SEQ ID NO: 1190 - DNA, 5215 bp, Homo sapiens
cgagcgcggcgcccttgagctgcaccgcggcgcaggtttgcgagccgacttgtcagccggccaagaaaaggaagctccgtcccttcccgctcacccggcttccccaccccttgtactctaaactctgcagagggcgagcggcgcggccacggaggcgccgaggaggagcgagccgccgccgggcagcggcgtgccctcgggggagagggcgccggagaggaggcggcggcgcggcggcgagggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacaaaaaaaaaaaaaaaaaaaaa

SEQ ID NO: 1191 - DNA, 2153 bp, Homo sapiens
cgaccccgagaggcccggttcctttaggccgcctgcccgcctccagctctcggggtcggctccaggaggcgccctcaggagaggggcgggcgctctattccagagaccgagtggcagggcggccactgtggcggggctctttccccgtttcgcctcagctacccctcagctccggtagtcgccagtccggggtcgtcgccgtttggggcgggagctgctcggccccgccgccgtccccgtcgccgcttccgggtccaggcccctcgggccgcctgccgccgtcatgaggctgcgggtgcggcttctgaagcggacctggccgctggaggtgcccgagacggagccgacgctggggcatttgcgctcgcacctgaggcagtccctgctgtgcacctgggggtacagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatgttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatgctacactaaaaatcaacaatgagattagaagtgtgaaaagattgcagctgctaccagaatcttttatttgcaaagagaaactaggggaaaatgtagccaacatatacaaagatcttcagaaactctctcgcctctttaaagaccagctggtgtatcctcttctggcttttacccgacaagcactgaacctaccagatgtatttgggttggtcgtcctcccattggaactgaaactacggatcttccgacttctggatgttcgttccgtcttgtctttgtctgcggtttgtcgtgacctctttactgcttcaaatgacccactcctgtggaggtttttatatctgcgtgattttcgagacaatactgtcagagttcaagacacagattggaaagaactgtacaggaagaggcacatacaaagaaaagaatccccgaaagggcggtttgtgatgctcctgccatcgtcaactcacaccattccattctatcccaaccccttgcaccctaggccatttcctagctcccgccttcctccaggaattatcgggggtgaatatgaccaaagaccaacacttccctatgttggagacccaatcagttcactcattcctggtcctggggagacgcccagccagtttcctccactgagaccacgctttgatccagttggcccacttccaggacctaaccccatcttgccagggcgaggcggccccaatgacagatttccctttagacccagcaggggtcggccaactgatggccggctgtcattcatgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattaca

SEQ ID NO: 1192 - DNA, 2954 bp, Homo sapiens
acgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccaccccgtttcagccctgtgctctggccccagaacggccactcgagaccccgggattcatccacatccacacctcacacacctgttgtcagcatcgagccaacaccaacctgacaaggttcggagtgatgggggcggccaaggtgacactgggtccaggagctccctgggccctggcctaccactcactggcctcgctccccctgtccccgaatctcagccaccgttgcactctgtgacctgtcccatggatccrrrractrratcttggccctgttgcctgggctgacaggagrrrrrrrtttttttccagtaaacaaaacctgaaagcaagcaacaaaacatacactttgtcagagaagaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttcttaatgtgagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaaaaaaaaggagaaggagcgccgggtggccaataacgcccgggagcggctgcgggtccgtgacatcaacgaggccttaaggagctggggcgcatgtgccaactgcacctcaacagcgagaagccccagaccaaactgctcatcctgcaccaggctgtctcggtcatcctgaacttggagcagcaa

SEQ ID NO: 1193 - DNA, 1909 bp, Homo sapiens
  misc_feature 42: n = A,T,C or G
cggagacggcggagcgggccttgttggcgtccactgcgcggntgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggacaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtcccaaaaaaaaaaaaaaaaaaaaa

SEQ ID NO: 1194 - DNA, 638 bp, Homo sapiens
  misc_feature 600: n = A,T,C or G
gcagctcattctgtttattaaggggggcccttgcatgggcccaacctttaggatgggttttttctgccccaagtaggggtcatggataggatggaagctgccaaaagcctcttaggcctggccctgggtgggggtcactgatgcagaggtggcagatggggccctggctgttcctcagggaggggcaagtaattggggtcttctgcaggggcatacacgagcagctttctgtggggaggggcccgagttgagcacaggccagcacaggtacccatcggtggagatccttctgagggtggtgagagggagggagggctctcaacactcacaggaagccaggggtctgcaggagcctcttgtctacaagctggttagtgaagacgtcctgcaagaagtagtagatatggcccaccgcaatccacagcacgtacacgaggatggagttgaccagcagcagcgagaagcccatgagcgcacaatgcaggaacggtgcctggaaagtgagcaagctcgagaagttgagcctcacccgagggctgcagcggcttcacacgtacaccagcattgtcatgtaggactagactcagaaagacaggctgntcaggagtccagcaggcctgtgccggatcttgccttca

SEQ ID NO: 1195 - DNA, 1140 bp, Homo sapiens
cgcagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggtctgggagactttgaagaccagtcctgcccgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagattccagatagcagggcatgaaaacttagagaggtacaagtggctgaaaatcgagtttttcctctgtctttaaattttatatgggctttgttatcttccactggaaaagtgtaatagcatacatcaatggtgtgtt

SEQ ID NO: 1196 - DNA, 3498 bp, Homo sapiens
cgggagtagcgcagtcgccaaagccgccgctgccaaagctgccgccactagccgggcatggccatggcgtccccggccatcgggcagcgcccgtacccgctactcttggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgaaaaaaaaaaaaaaaaaa

SEQ ID NO: 1197 - DNA, 2997 bp, Homo sapiens
ggactgcggtctcgggcagcaatggccgagaagcgcgacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctgacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccacaggcaagaacctgggctgtaactgccacctgacaccgctgactggctaaatgctttgcagaaagtgatgaccttacaccacaaccagcttctccaggtcatatgtgccttacctccagaagtctttttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctccaaagtgctggattacaggctgagctaccaccctggtttggagagtcttaattaattgaaatttccctaatgttcatttattttctaaatccagccgtgtttcagaataatccttacttgagagtagccattttcttgtgtacttgtcagaactagaggaaatagccaagactaatgaaaaacattactctaacccttaaaagacttttaaattcactactagagtggtcattttaaaaatacatccatgttttaacttattttgagcctttcttttatgagtaaatgattcctccttgttctgtctttcaaaccagctaaatatttgtcacaaaagtgacttttttctcactgttgcctattttcatatatcaggttttaaatagttttaattttttaataaaatttttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgactgggcagatactgtcaacttacaatatctatatagagaggctttaaacttaccttactcattctctatgatgtatgacttgatgctgaaagaggaagctggtcagctcctcatggacaacaaattcttagtctataatattaggagacatctctagttttgcaaatgtctgtgaatctgagcaacctggacttctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtccttccctgtacccaattcaagcttattttagggaagccttgaaactaccatgtatctggctctagctgagttattgaggattgagccagtgcaacgttaaactcagtgcacttacatttgatttaaatgatggttttatctgttgtgtgaagtggttcacccttgaggaccaggagcctccatatcctgactgaaaaccttttctgagacttagagtaacagtacttttggttccttgagttctcctgtctccagatacctaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcact

SEQ ID NO: 1198 - DNA, 4740 bp, Homo sapiens
ttccggtttttctcaggggacgttgaaattatttttgtaacgggagtcgggagaggacggggcgtgccccgcgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcacgagttgacctagatgagatgtcgttcactttactgagctacagaaaaacatacgaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatcgaagattatttttggatcatgataaaactcttcagactgattctatagacagttttgaaacacagagaacaccacgaaaaagtaaccttgatgaagaggtgaatataattcctccacacactccagttaggactgttatgaacactatccaacaattaatgatgattttaaattctgcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgagtcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtc

SEQ ID NO: 1199 - DNA, 1243 bp, Homo sapiens
gggcggtggcgggcgctggtgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaatgaaggggaattttctacagataccaaaggaaaaccatcttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatttgataccccaaaaa

SEQ ID NO: 1200 - DNA, 3481 bp, Homo sapiens
gggggcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaataagaagttgtagaaggagagaaggaagtcgaggctttgaagaaaagtgcggactgggtatcagactggtccagtagacccgaaagcattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctcccttaaaacgagatcaggttagcaaatgatgtaaaagaagctttattgtctagttgttttttttcccccaagacaaaggcaagtttccctaagtttgggttgatagttattaaaaagaaaacaaaacaaaaaaaaaaggcaaggcacaacaaaaaaatatcctgggcaataaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgtcttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcgacagattccttcagtgatatacttgttcgttcatttctaaaatgtgaagctttaggaccaaattgttagaaagcatcaggatgaccagttatctcgagtagattctcttggatttcagaacatctagcatgactctgaaggataccacatgttttatatataaataattactgtttatgatatagacatcgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttcttcctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagtaaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgcatcgttatatacagtttacaatacatgtataacttgtagctataaacattttgtgccattaaagctctcacaaaaaaaaaaaaaaaaaaaa

SEQ ID NO: 1201 - DNA, 623 bp, Homo sapiens
ttttttaagtctgttttcctttttattttataaatgtattttattttatacttgtttaatccatcttagacctagcacatcctagggttttatatactgatcaaattgctctgctagagatgcttaagttcaatagcagtttcctttcaaacttatccgtttttaagaaatgggagtctgtttttttaaattttatacatgtttattttcattataaatttatgtaaatcactttggacccagcatgtccttaggttttacccattcgtcaaactgctctgctgtgagatagccaagttcgatagcagtttccgttaaggttgatccatttttgtgtgctgtcttagcaatctttgctgccttgtcataccctatatggggattgagagctgtcaccaacattagagactcattcatcagcttgttgatcctttctgtattggcctggattcccaccacgcagttttctgtaaaggaaactgaagcatcccccagcagcctggctgagtgtaacacatttttagtcatcattggcttgagaacattcatctccaaatgtccattgctgccctcgacagtgacagcaacatggttcccatgactgtgctgcaccatgtcattgc

SEQ ID NO: 1202 - DNA, 662 bp, Homo sapiens
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 1203 - DNA, 836 bp, Homo sapiens
cagtctctcggtttcttctcagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctga

SEQ ID NO: 1204 - DNA, 1204 bp, Homo sapiens
cgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgaaaaaaaaaaaaaaaaaaaaaaaaaaaaaaaaaaaaaaaaaa

SEQ ID NO: 1205 - DNA, 8300 bp, Homo sapiens
agaggctgcggtgagtccgccagccccagctgctcctcctcaagcccccaaggcccttcggcgggcccctgctgaaagaccggcatgccctattctgtgggcttccgcgaagccgatgctgctaccagctttctgagagcagcaagatcaggtaacttggacaaagctttggatcacctgcggaatggggtagatattaacacctgtaaccagaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtgaccccgagccgctctccttggagtagcctctcgggaggatcacacctcgacacccaacccctgaaccccacacactctgccatgcacacaggaggagagctggacctgagggccaccgcagcggtgcacacattcctctgggctgacggcatgacctctgtaagggactcctgctagtcccctcttggcatgaatgactgactgtagacgcatgacctccaggcttcaatcctgcctcttgcaatgacagctgatctgtcggaaccaggacacaaaagcagcaagaagcggggagagagagggatagaaaacaagcgcaggagagcctgcgaacgcaaaagtgaatgagggctttttgtggctggggatgggttttggttttggggttttttttttaaattgttttgacttcgtacagggtactttttcccaacctcatctgtcagaaatccatgtgggcttcctggaaagaaaaaaaaaaaaaagaaaactaggcatgaaatcagtttaacaccttaatcttaagccatgtcctcatctgcccaccctccccaacccacatacctccattccacttgtgacaccccctcgactccctggtgacgctcctcccagatcgctctacatgacattcaggacacacacacacacacacacacaccactcgcctccactgaatctacacacagattttactgtgacttctgaagctgtatagactctgctgtggataaattggaattttttatgttgtctctctctctgccaatttcaatacgaatcatcttccaatggaaaatcattaccttgaagagtgcattcggggttccttgtgttagggacttaagaatctgaggcgaggacccccaggcttacctgtaggactcaaagggagccaggaccccatctgaaagggtctcctctctcagttgggggacaggccggtggctgacccaggattgcaccagcatgtccatagagaagaggttttctatgtcttcaagcactatatcatagtccgtgttcaaagtgtaaactgtacagtaatcagccttgtgtatatgaaaaacaataaatactatgcaaaccaatagaaacatttagcagtacgtacagagcctgacagcgcagctcctgaggacttctgcggctgcaggagaaggagctgtggcctgtctttcagtgaaagaggaaggaaaggagtagggctagtgaatgtatctgccaggtcttagaagtcaggaccacccagggtctcccagagtgaacttggtgctctaagtccaggcagcctgcaggctggggaccctgggtgcaggtgccaggctcgaggctgttccctgtcctgcctcagtgcctcccctctgcccagcccctgtggcctcttggagaggcgagccagggggctccccggaccgcatggccggtgagagtagagtcggaggcggagagcctggacgcccagaggccggggccaggctctgggtcaaggcaggaaggagacagacagctggcagttcctcgcctcggtgccatcagggaggagccttaagttccactagagcctccggcccagggaggccagaatcagcacaatcccggccccgccctcgcggcgggcgcccccagggccaggagagagagacagggctggctcctctcgcccctggagccgcggtgtggacggcccggccccgtccgccccgccgctctgcgggagtgtcctcgggacacacttaaaccttccaagtagcacagaagccccctccacgtcagaggccccctggccgcggggcctgtgagcggagaggggccctgcttcccacacaaatccgccccggtgcacccccggccaggcaggccccggggcggcctaggcgccttgtcggccgggggtggggctgcttttgcttcctttagaggggcgggcagggagaggaagctctagctccgggcctgagtttccccgaggctgcgtcggaggagctgcagggcgagcccggacggctgccgtctccgccagaggccaccccggcccggcctccagggcgcagaggcgcccccctccatcctcccccatcccgggggccacggcaggggggccgcacagcgcggctgggaccgattcggtgacggcccaaggaagctgggctcagggctcgcctctcccgcctcgatcctgcaccttcctctcccaggtcgctgctgcagccaacccagtagcccccttagcgcccccgcggaccccgcagctccagactccgctttggcacctctgctccggctggcatggctgcacgctccggctgctagtaggagccgttaggggaggagtttggggtctccacacgatgcctagagaatgctgcagtctgcacattagacgctttttagaagttttgaaattaccttgatttttttaattgttatgaaaatggatcttttcttgactctcccacatgctctgttatgggagagaatcccctaccctactctgatgtatagaccattctcccttcaccagccgaaccaatgtcaaaattaataaagaaatggactaatggcaaaaaaaaa

SEQ ID NO: 1206 - DNA, 1223 bp, Homo sapiens
aattccgggcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataaaaaaaaaaaaaaaccggaatt

SEQ ID NO: 1207 - DNA, 5179 bp, Homo sapiens
acctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctggccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccaaaaaaaaaaaaaaaaaa

SEQ ID NO: 1208 - DNA, 3748 bp, Homo sapiens
cttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcacgaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagtgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttataaaaatgacaaatatgtactgtgttgtgataaaaagtattttatttgtttaatgatatgcatgcttttcttctgtaaatatataataaatttttgtagatagtcttgatgtgtg

SEQ ID NO: 1209 - DNA, 3492 bp, Homo sapiens
cacgcgtccctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaacaaaaaaaaaaaaaaaaagg

SEQ ID NO: 1210 - DNA, 2700 bp, Homo sapiens
gcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgaaaaaaaaaaaaaaaaaaaa

SEQ ID NO: 1211 - DNA, 2156 bp, Homo sapiens
gcgcatgcgtggattgtcgtcttctgtccaagttggtcgcttccctgcgccaaagtgagcagtagccaacatgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtgggctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgttaaaaaaaaaaaaaaaaaaaaaaa

SEQ ID NO: 1212 - DNA, 2634 bp, Homo sapiens
caggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcaaaaaaaaaaaaaaaaaa

SEQ ID NO: 1213 - DNA, 649 bp, Homo sapiens
agaatacactcacaagccactccgctgctcgcctctccgccccgcgtccagctcgcccagctcgcccagcgtccgccgcgcctcgccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 1214 - DNA, 503 bp, Homo sapiens
  misc_feature 461: n = A,T,C or G
tttacaaaaagcaacaagagtttaattctctttttacatggccacaggctctcttcagtcaggggaacttcagctggtgcctctctcttgcagctatgaggcgacagtgtggtgacatgcctcatacagactgtcccagtaagccaggacaagtcaccattaaaatcttgcatgaacagccctgggcacgtgggaatgttaagaaagagccaccgcctccttagtcagcttaaccacagctccaaacgcagtttgtcccagctggcaaacgcctcaaacaccaatcatgcgtcgtgctcctattctgggtttttataaaacacttttatatagcgatatagatagcacagtaaatgtgcttctgatgcactctaacatagaggacaggaatacacactgtggggcgccgccccagccatctccacagtggagaaagtgcgagggttaaatacacgtggcgnggtggcagacggcaggaagttacagagcgccacgctccacgt

SEQ ID NO: 1215 - DNA, 2647 bp, Homo sapiens
gccgcgctggtggcggcggcgcgtcgttgcagttgcgccatctgtcaggagcggagccggcgaggagggggctgccgcgggcgaggaggaggggtcgccgcgagccgaaggccttcgagacccgcccgccgcccggcggcgagagtagaggcgaggttgttgtgcgagcggcgcgtcctctcccgcccgggcgcgccgcgcttctcccagcgcaccgaggaccgcccgggcgcacacaaagccgccgcccgcgccgcaccgcccggcggccgccgcccgcgccagggagggattcggccgccgggccggggacaccccggcgccgccccctcggtgctctcggaaggcccaccggctcccgggcccgccggggaccccccggagccgcctcggccgcgccggaggagggcggggagaggaccatgtgagtgggctccggagcctcagcgccgcgcagtttttttgaagaagcaggatgctgatctaaacgtggaaaaagaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacggacagaagatgacctgagttttcacaaaggagaaaaatttcaaatattgaacagctcggaaggagattggtgggaagcccgctccttgacaactggagagacaggttacattcccagcaattatgtggctccagttgactctatccaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactaaaaaaaaaaagtattattttccaaaagtggcctctttgtctaaaacaataaaattttttttcatgttttaacaaaaacc

SEQ ID NO: 1216 - DNA, 1005 bp, Homo sapiens
cttctgggtttccaccaattggcaagaagggatcagcctgtcctagagatcactcctctgccaaagatcccaacaagacaacatggctcccaagaagcctgagcctaagaaggaggcagccaagccaatgaatgtcaagatgctggactttgagacgttcttgcccatcctggctccagctccagctccagcccctgcaccagcccctgccccagctcagcacatttcccgcaacaaggagcagggcacctatgaggacttccctgaggctcccaaggaacctgcctttgaccccaagagtgtaaaggtggagggcctgcgtgtctttgacaaggagagcaatggcactgtcatagacttcactgccgaccagattgaagagttcaaagaggcctttatgggtgctgagcttcggcacgtccttgccaccctgggagagaagtcattgtttgaccggaccccgactggagagatgaagatcacctacatgactgaggctgaagtggagcagctgttagctgggcaagaggatggccagtgcggggatgtactgcgggccctgggccagaaccctaccgccaatggctgcatcaattatgaagcctttgtcaagcacatcatgaatgccgaggtgctgcgtgtgctgggcaagcccaagcctgaagagtcagggtgaagcagagtcttccaggtgcctgcccttggctttagccataccagggtgagttaaagagaggcccggctgggtgagctgagatggagtcctcgacttatcaccacaccactgccccaaggacttacaggccctccctgttaataaacagctctaacacggccaggctgggctctgtgaagcagagtcttccaggaccgcaagaccaacccttcctcctcctcagcctactcaacctgaagacaaggaagatgaaggccttgaagattatccacttccacttactagtaaatatattttcttttccttatgattttcttaatttttttcgg

SEQ ID NO: 1217 - DNA, 2514 bp, Homo sapiens
ctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctccgtgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagcgtgccggagactgggacaagcagcctgtcaaggtgcctgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcggggctgcacacccagcagcagcgcacgcctccgaagcctgcggcctcgcttgaaggaggcgtcgccggaaacccagggaacctctctgaagtgacacctcacccctacacaccgtccgttcacccccgtctcttccttctgcttttcggtttttggaaagggatccatctccaggcagcccaccctggtggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggcggcggcacagcctgggcctccccttccctcaagccagggctcctcctcctgtcgtgggctcatttgccaggctcaggccaggtctggacagctgtgactctcctcaagccaggactaccgaccagccggctatgggcacattacgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 1218 - DNA, 1791 bp, Homo sapiens
ggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctaaaaaaaaaaaaaaaaaaaa

SEQ ID NO: 1219 - DNA, 596 bp, Homo sapiens
  misc_feature 582: n = A,T,C or G
tttttaagctgtaattttcacaatattttaattctgttctgagatctacaaatatctctacataacaccaaagccagtgatttaataaataagaggaatgtatatatcgctttgcaaaaaaatgcctgatacatttatctctatataagatatttgtagaatcagtttcccaaggctcacgaaactaaagtgcacacacacacacacaccatgtacacacacacactattcaaatcaaatggatttatattaagtgccaaattaaatgctatacaaaatttataaccagatacacaaaatatgaagtcaatcatgaatccactgttgataatggataccatacctcacaagtgtgatttccagttaagaagagggagacaattgcttcattgggtttttagtgtgtgctaatcaccatcaccatcacaagttaatcagtttaattacatggtattcagagattaaacacacatgcagatattaaatggacactacaataaaacctttaaatctgcaaaaagacatgagaacacatggtcaataataccactcgctgccacagcttttcagtagacaatgcanatggcaatcagcgt

SEQ ID NO: 1220 - DNA, 2902 bp, Homo sapiens
cccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacactaaaaaaaa

SEQ ID NO: 1221 - DNA, 847 bp, Homo sapiens
acagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacgccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagacgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaaaaaaaaaaaaaaaaaaaaaaaaaaaaaaaaaaaaaaaaaa

SEQ ID NO: 1222 - DNA, 806 bp, Homo sapiens
gttaaatgtacaaggatagtgatacagcctcctcctttcttaggtttcccaccattttcgagaactcatgcagctcttccacactgcctgtkaagccagcgctgaggatgaggatgatgctaccagttccagcgatgcagakcagctgtktgaccatggggaccttctgtctgawgaggagctggatgaatgagactctgggaatcatctacacaggaccaaacccaacaggcgccctggcaccggggaggcgggtggttgtgctctgcttgttcagtccttgagcccagtttacagatctggagagcaggaggccaggacaaggacaaaggctggaggatggagtgggacccaggggctctgccatcctaggcatcattcaaggtcttttatgaagactttacagatgttctctgttagtggcatcgagagtggagtgcagctcctttctctacttttttttggtctgatggcacatatttattgttctgtggtctaatcacagtgtttctaaatgtaaaaagtgcatatgttggtgtagctagttccgcgacattgagctcctctgcatgaagacactgggctcctgcatccagctgtgtttattgcaaactagctcctttctcccacactgggaactttagtccacgaggctgttaccaccctggtagcactgggccaggctttgtagctcctgcagcagccctgctacgtcatcgtgctccactccagcatccatgaagctggcccagcgccgcaagtkgagtktggtgaggtctctggccaaggcttccagggtctggtgc

SEQ ID NO: 1223 - DNA, 735 bp, Homo sapiens
ttcagcagataatagcacttttattagcagtactcagcaggaaaagaaaaagcagttcctggttgttatttctgttttctctgtttcttagggcgtccacttttcttctgtcctttcttcttcgttttaaggagaacagctttttctccaataaataagcttttaggatgtccttctgcagttttggaagtaaaattaagtccctgcttaggtttactgacattcttcaatcgtggatttgaattttgttgtttaaatttttctttattaacagaacgcatgactctgagttttctccccatgagttcagaattatttaatttcagagcaagatgaacagaatctgtattctccaagagcacatagccaaaccctttgccgatgcctgtcattttgtctctcacaatcctcacggccatgatacttccacagtccagaaagtgcttctcaatggcagattcttcaactttataagggagattccccacaaaaaccgatctcttgtctctagatgaggtctcagatgcgagatcaactctaatacgaaatccatctgcaatctggggcacatttcttttcaatgcttgcgtggcaagactctcccccttaaacacaacataggcattaatatttttccgatccggatggattttacggtttattgcggccaacttttgggatagggttccctcgctggaatccagaacgaaatcgtacagattccattgggccaaa

SEQ ID NO: 1224 - DNA, 1086 bp, Homo sapiens
tttattaaaahwtttaaacttatcattaaataaaaatctttaaatggtacacctatgaagcaagamttaaatataaacccagtctaatcctgtacacttgtbattaattgtkacawtcttaagttgctcacttctttcccatttaccatttcwkwkawagcccgtttcctgttttctcctcaccactttgccttggcatcacaccaaccctgcctcgggcttcagctgcagatcctccccagcccctcctcccagctgggctgactccagtcccagccccagtctccaccaactgagcagcgtacgcagggttgtgtctggcttccagcatctaccaccccttcagagcaacttccaacatgggacaggagaggaagctcgcattgcttggtctgaacagatttaaggrggttttatcacaaggacctgaaaacttcctaagcatgctttctccttgcacagctgaggaggggcaatggtgggagcggggcaggggggtggcaggggcggcaggggctctcaactaagggctctgaatcacagaggggacagatgctgccttagtccttcttgcctcccagggccaggcttcttgtgaggagctttcctgggctggagggggtcagtgtggagactgtgggggattccagcttcactctgtctaagagggtcttcttaagggcagctggggagatcttttcttggtcggccatggactgtagctctcgtgttcggatacaggaggcctcaactgcattgatgagcagagagcggaagcccccactctctagaaagtgcagggcgtggatggtggctccccaggggagcagacattgtccttaagctggcatggatgctgctccgagtccagcagcatcttggcagctccagcaaagcctgggccccgagttggattgccaggsgccgtggsaaaccatcttcacccaccatcagcmatgcgtccagagcatgaatgcataggcaggccgctgcactgagcccgtgacggmtcgatgagtctcttcacctcagtgagaagccacgctstcatgastgctcaagagygccatctcamsaggggakggg

SEQ ID NO: 1225 - DNA, 2858 bp, Homo sapiens
gcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 1226 - DNA, 4221 bp, Homo sapiens
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 1227 - DNA, 1293 bp, Homo sapiens
cccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttg

SEQ ID NO: 1228 - DNA, 1345 bp, Homo sapiens
ggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaaaaaaaaaaa

SEQ ID NO: 1229 - DNA, 1072 bp, Homo sapiens
caggaagaggatgctttggaagaattaagcaggcagctttttctggaaacagctgatctatatgctaccaaggagagaatagaatactccaaaaccttcaaggggaaatattttaattttctaggttactttttctctatttactgagtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcggttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaaaaaaaaaaaaaaaaaaaaaaaaaaaa

SEQ ID NO: 1230 - DNA, 13509 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 1231 - DNA, 624 bp, Homo sapiens
ttacagtctctgattttaatgagtcaatctcaaggcaaagctataaccttttccatgtgaaccttaaaacggaaatcctacgtgtttggctcagctaccatagacatgtcttgccccagagttccagtgtatttttcacctttagtttcttggctcctctccgcctctacaccagcctcatatccacacgggatgctctctgctgagtattgtcttgagttagttctccctctcatgttctggctgatgctactcatggtcataggaatcccctgacggggaggagtatgctatgaaggtgaaaaatgctaccatagcattttgtttgtttataaaatgtcaggccctggttccatttttcccccctcttatatctaaattttgaaaccactggcctctaacagtctgtagtaggcttaagttcaaggtgccatttgcttctctggtgcctgtttgtgagccaaatagaggaagagtatgctagagagagcgctgaccaggaagaaacatcaaacaacggtgatagaagttgaactgcagttctccaaggactgcagtgattatggtgcgtattctaaagcatactcattcgatccgcagcacagaggagaccaagtacatgcc

SEQ ID NO: 1232 - DNA, 1428 bp, Homo sapiens
agcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaaaaaaaaaaaaaaaaaa

SEQ ID NO: 1233 - DNA, 3256 bp, Homo sapiens
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtaaagaaaaaaaaaaaaaaaaaaaaaaaaaaaaa

SEQ ID NO: 1234 - DNA, 1928 bp, Homo sapiens
ggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaaca

SEQ ID NO: 1235 - DNA, 2091 bp, Homo sapiens
gagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgccatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttct

SEQ ID NO: 1236 - DNA, 1955 bp, Homo sapiens
agcttgatggcgtcgggctggagagccgcagtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactacttttgtctcctctgtctcagtgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgtaac

SEQ ID NO: 1237 - DNA, 1449 bp, Homo sapiens
gacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattcaaaaaaaaaaaaaaaaaaa

SEQ ID NO: 1238 - DNA, 1390 bp, Homo sapiens
gggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttcctttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaaaaaaaaaaaaaaaaa

SEQ ID NO: 1239 - DNA, 583 bp, Homo sapiens
  misc_feature 14: n = A,T,C or G
cacgaggcgcaaangactttttttttttttttttttttttcactagacaaaaatctatttttaattgtataaaattatacatataaaatacatagaatgtactaagaagatgagtaaaatctttgacaccagaagtggacagatcaggaaacaatttttctcaagttatttgggatcttactggttggtatttgagaaaaataataaatccaggaggtacgagggcaattcttcccacaactcacaccccttaatccacacgtcccagagaaaggagaaacaggagtgttgatgagtgccagcttataaatgtcaaacagacacacctggtgtgtctagctgtttttgcctttactccaacccgacgtgtttcatggaatacaaacatggggcttctaccccagctctcttctgattagtaagaaaaaaaaaatgatagggcctggagaattcaaggaagcccgtttcaagcactaataaaattgtagctggattccttacctcttacccaacatgatttcaaaagcaagaaagttgcctttcatcttgcccctatcaaatccaaaagagccaattatagcct

SEQ ID NO: 1240 - DNA, 5261 bp, Homo sapiens
ctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagataagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 1241 - DNA, 2162 bp, Homo sapiens
atgcgccgcgctcgctcgcgggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaaaaaaaa

SEQ ID NO: 1242 - DNA, 483 bp, Homo sapiens
  misc_feature 427, 439: n = A,T,C or G
ataaaaaagtgctttttaatttttagccagaatggtcaagttgatgtagattttttttactggaatactcataataatgtctgtctatatgccttaagcaagattattatttaataaaagatggcaggaagttgtaatttatggaaaatttacaattattctttaaaatacttttataaaattataaattgataataatccccccaaactgaagtgaaatacttttaatactacttgaaattaaagtacagttgtttatacaacaatgaataaggacaagatatcaaactgaaaattcaaaaataaacagaagaaatgtaaacagttctaaaatatcagtatttataaatgttgcttagaggaaggctattcaaagcatggtccattaactatttgtgagctgtccagaatgaaagaggcctgtgcngaatgaaaatcnattacatcactaatcatactgggctcagttggactttttttaaa

SEQ ID NO: 1243 - DNA, 591 bp, Homo sapiens
  misc_feature 551: n = A,T,C or G
tttgggtaggctagatacatttattaatagtaaaagcaaccatggcaaaagcaaccatactcattcttgataatgaaaggatcttctatatacaaacctagcaaattaaaaaaaaatactaaaacaaagtgtctgaagataatgaaaggcagttcaattcatgtaatgtcaagtaactttcaattgtaatagaatcatttatattcttatagtgccttacagcatattttatcgttaatgagaaaatgaaccaaaactatagtgctaaccctgaaaccttaaaccgaaccttacaaagttaaagactaagtgttggtcagaaggaaaaggatgcaaccatgcatcttccacagggaaaatgaaaatagcaagatggcagaaatgctgaactcatgggtacaaacacacttttctttataaaaacaaaacaacacacacacatacacacagaaattattacaatgcaaatcatcatgtgtctctattttctaccagctggtgaacctgttattaaaatttaaaagaaaaaatcaattaaactttttctattntaatccatagaaatattcagtaacataaatacaacatttg

SEQ ID NO: 1244 - DNA, 2110 bp, Homo sapiens
ggatccaagctattgtcctgcccatggcttcccatctcaggacgctctctggccgctatcatcccagcagtggagttcagcccactactctgaaccagccgcaggtggctgctatgggactgaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgtcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 1245 - DNA, 771 bp, Homo sapiens
  misc_feature 692, 729, 762: n = A,T,C or G
atagtttaatgtattttaatagcaaacttacaggaacagcacagaagacagacaacattaaaaacatgtacttgcatgtaggacaactcagttagaaaagtatagtgaatggatggaatctactgtatgataaaaatgctacaaacaccatttagttgccatcaataagaaatttacttgttttaaaaaaatccaaatgctggcattgtccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaaatatctaacgttcagaactaccaataacaggaagaagagaaattttttttttttttttgagaatgaaatggttccaatcatagtggattcttaaagacgttcttcacgtatggcgcgtgctaagctgatgtcttttggcataatggtacacgtttgccatggatagcacacaaggtgtgtctttaaaaaggccaaccagatagggcttactttgcttcttgcaagcaccgatagctgcggctctggaaactgcagatctgntttaaagtcctgagcaatttctcgcaccaaacgctgngaaaggagtttgcgaatagaagttagtgacttntggatacgt

SEQ ID NO: 1246 - DNA, 4088 bp, Homo sapiens
ttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactac

SEQ ID NO: 1247 - DNA, 1861 bp, Homo sapiens
gggagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcatcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagcctgggtgatagagtgagacactgtcttgccaaaaaaaaaaaaaaaaaaaaaaaaa

SEQ ID NO: 1248 - DNA, 1674 bp, Homo sapiens
gggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaa

SEQ ID NO: 1249 - DNA, 582 bp, Homo sapiens
ccaaaccacttaagaagttttattgaaaacgataaaatacagtaacaccagattctcattttaaagtaaaattaacagcatcttccagaacattcctagaactgaaccattcttgtcactattgaaaaacaaagccaagttccaaatccaaaataataaatgaacgtgctgataaacattcttcttatggttccagcccctactttagttattttcctaaattttacatgtgtaccttttcaagaaagagtaagttttttaagtgatcaatatttatgagaactggactttcttcatataattacaaaaaaaaaaaaaaacccaaaaaacaaaatccacaacgcaccctactcaaactcagataaaatacacatttgttcattaaagctcacctgctttagagaattttttctcttcacacattagcacagtaagccaatgtttgatccatgctgcaaaagctacacaaaacgaaaagccctggtaactccctagggaactcttaaggcaaagcaaaagcaaaaaccttatgctacaaaagtaaaacaaaaagcagaggcattgggactgtggagacggctc

SEQ ID NO: 1250 - DNA, 584 bp, Homo sapiens
  misc_feature 547, 578: n = A,T,C or G
tcttcagaacctttttattcatcatctaaccaacagaggtggttggctcgaactcaaactaaaatggcctcaaaaggccacctcgttacgacatgacagggcaaaaccagaagtagggacagagtttagcctcagttctctgcagagaagaccaagcatgtatttacacacaggtgcctcattaagaactgattggcaatgttccaccagcacagacccagagtgtgcagaaatccgtgggggctctgtatatgtgtcattcagacaatccgccgattcctcagccataaacaagctcttgctttttgggaggagggtgatcagcatgttatcttgaatgatggcaccatttgtttactctggaactttgaaggggaggtgacaacttattttctcccctgaatctgagatgcagtggcctgtcagagtatctaaaaatggtggtcctggaagacaggtgggtgggtggttgcccctaacagagagtttacaggggtaattggtgttggggctctttcagtacttaatcctgctgtttttcagaaanccctttgcacctgggccccatggagcagcanggccct

SEQ ID NO: 1251 - DNA, 1232 bp, Homo sapiens
aggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctccccttttccttttcccagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaac

SEQ ID NO: 1252 - DNA, 1593 bp, Homo sapiens
gttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgttggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaaaaaaaaaaaaaaaaaaaaaaaaaaaaaaaaaaaaaa

SEQ ID NO: 1253 - DNA, 4098 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgtggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctaagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 1254 - DNA, 10174 bp, Homo sapiens
gactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacagctcgacatggattacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaaaacaccagaagtgccaccagcacagccaaaacctggggttgcagctcccccagaagtagcacctgctcccaaatcatgggccagtaacaagcaaggtgggcaaggagatggaatccaagtgaatagtcagtttcagcaagaatttcccagcctgcaggcagctggggatcaggaaaaaaaagaaaaggaaacaaatgatgacaactatggacctggacccagtttacgtccaccaaatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatatgttccaacagtatccgaggatgacatatcctcctctacatggtcccatgagattcccaccttctttatctgaaacaaacaaaggccttcgaggaagaggcccacctccttcatgggcctctgagcctgaacgcccatccattcttagtgcatcagaactgaaggagcttgataaatttgataacctagatgctgaagctgatgaaggttgggcaggtgctcagatggaagtagattatacagagcaactgaatttcagtgatgatgatgaacaaggaagtaacagtcctaaagagaataacagtgaggatcaaggttcaaaagcctctgaaaacaacgaaaacaaaaaagaaacagatgaagtttccaacactaaatcatcttcccaaatacctgcccaaccatcagtagcaaaagttccctatgggaaaggaccttcatttaatcaggaacgtggaacatcttcacatctgccaccacctccaaagttgcttgcacagcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggaacagatgaaacagcagcagtggcagcagcagcaacagcaaggtgtacttccacagactgttccttcacaaccgtccagtagtactgtccctcctccaccacacagacctctttatcagcctatgcagcctcatcctcagcatttggcttctatgggttttgatccaaggtggctcatgatgcagtcctacatggatcctcgaatgatgtcaggaagacctgctatggatattccacccattcatcctggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaattaggtcccattagtccaccacagccaccttcagtcagtgcatggaataagcccttaacatcgtttggatcagctccttcatcagagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggagtctgtaacagactatactacaccctcttcttctttgcctaacaccgtggctactaataatacaaagatggaggatactttggttaataatgtgcccctgcccaacacccttcccctccctaagagggagactatacaacagagctccagcctaacttcagttcctcccactactttcagcctcaccttcaagatggagtctgcacgcaaagcatgggagaattctccaaatgtaagggaaaaggggtctccagtaacttccacagcacctccaattgcaactggagtcagcagtagtgccagtggaccaagcactgctaattacaattcgttctcaagtgcatccatgccccagattcctgttgcttcagtcactcctacagcatcactatcaggagctggtacatacactacctcttctttgagcacaaaatctacaaccacatcggaccctccaaatatttgtaaagtgaaacctcagcagttacagacaagcagcctgccttctgcaagtcatttttcacagttaagctgtatgccttcccttattgcccagcagcaacagaatccgcaagtttatgtgtctcagtctgcagcagctcaaatcccagccttctatatggacacaagtcatttattcaatacccaacatgcacgattggctccgccatccttggctcaacaacagggtttccaaccaggtctctctcagccaacttcagttcagcagattccaatccctatttatgcaccactgcaagggcagcatcaagcccaactgagtttgggggctggccctgctgtttcccaggctcaggaattgttcagctcctcacttcaaccatatagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggccagagcaaatcttacccaggcctcaaatctttattctggacaagtacaacagcctggtcagacaaatttttataacactgcccagtcaccaagtgctctccagcaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaaatgtctgaaatggaactaaaagcctttggaagtggcattgatataaaaccaggcacacctccaatcgctggtagaagcaccacaccaacatctagtccttccgggctacttctacaagtccgaacagccagtccagcaaaatgaacagcattgtctaccagaagcagttccagtcagcccctgccactgtgagaatgacacaaccatttcctacacagtttgcaccccaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatga

SEQ ID NO: 1255 - DNA, 682 bp, Homo sapiens
gcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgag

SEQ ID NO: 1256 - DNA, 963 bp, Homo sapiens
atccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacagag

SEQ ID NO: 1257 - DNA, 3279 bp, Homo sapiens
gacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaaaaaaaaaa

SEQ ID NO: 1258 - DNA, 1708 bp, Homo sapiens
gaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaataaaaaaaaaaaaaaaa

SEQ ID NO: 1259 - DNA, 2490 bp, Homo sapiens
ccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgttatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattaaaaaaaaaaaaaaaaaaaaaaaaaaaaaaaaaaaaaaaaa

SEQ ID NO: 1260 - DNA, 1086 bp, Homo sapiens
cgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacccgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaaaaaaaattcggggggataaatgagcgaggggcggacaaacacacgcggacccgcacacggggccatgggccaaaacgccggtcctggaacccaggtttcttggcccacaggcgcacacgcgccgggcaccccaaaggcagagccggataaatgcgaaaagcccaggtaactggtggacatacggaccgcagcacgagacacacgcgccgagtaacacgcgcccacaatagggcggggaatatttaggatcacgacgaacaaacacgtgcaggagcctacgcacaacaagcaggagacacggggtggttaggataagaacaaaaaagagaaaaacaaggcgaggaggccaacaagaaagaaacacacaaaaaagaaaaaaaagaagacaaagagaacgaacagacgagtgaagagaccgaagagagccaacacagacaaagagacagagcgacggcacgaaggcaggaccacacgacgcgaaccaacgacaaaccgacagcgagaccagagcaacacacatacacaaggcgagagagacaacggaagacgagctggaaaac

SEQ ID NO: 1261 - DNA, 1330 bp, Homo sapiens
aattcccaaatgaccttttatttcatacagagatacaaaggcaactatgtgcagcaacaatctgatgggcagtccaaactcttgggaggaagtaaattcatggtaaatgtcatgatggcggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatccgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttagggactgcatgggggaattc

SEQ ID NO: 1262 - DNA, 5297 bp, Homo sapiens
caacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 1263 - DNA, 481 bp, Homo sapiens
tttttttttttttttttgcttttccattataaaaatttatcaagggaataatttgagtttttagaggcttggtttagcaaggtaaaaaagacaaccaaattattaaaacactttataaattattttaaaacctaccaactggggcctaaatgaaataaaccccctattaccttaggaaagagacagctttcctaaatcacagaagttggtttccaagctacactcttacttctaatgccttggaaccctaaggagaactaaagctcaccagcgatggctgctctggaagtcaaggtgggaagaacaggcaatatcctgacacaggctagatacagactctgagccaaaagcagactctgtgacatggaaagggaccacacaattttaagtttttttttttttttgagacagagtctcgctctgtggtccttgttaagcagtttctagcctgtcctacccgaatttgcatgtcccgtctcaa

SEQ ID NO: 1264 - DNA, 2433 bp, Homo sapiens
ggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttatagatatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatttcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaaaaaaaaaaaaaaaa

SEQ ID NO: 1265 - DNA, 6541 bp, Homo sapiens
agccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtaaaaaaaaaaaaaaaaa

SEQ ID NO: 1266 - DNA, 5021 bp, Homo sapiens
agcacgaaaggccacgcaggccgttctaaccctggcggccaagaggaggggtagcaggctctggaacctgcgggcggggacgaagacggcgcgcgacgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagatggcgacgctctctctgaccgtgaattcaggagaccctccgctaggagctttgctggcagtagaacacgtgaaagacgatgtcagcatttccgttgaagaagggaaagagaatattcttcatgtttctgaaaatgtgatattcacagatgtgaattctatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacagtcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaactaaaaaaaa

SEQ ID NO: 1267 - DNA, 1578 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaa

SEQ ID NO: 1268 - DNA, 1940 bp, Homo sapiens
cgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaaaaa

SEQ ID NO: 1269 - DNA, 504 bp, Homo sapiens
  misc_feature 459: n = A,T,C or G
ggtatttacttagctatgataaagaataaaaagtcatttaaaaaacgcgataggacagataacagactcacaacgtatttagatttaaacactgctggtctacgtaacctgttacaaaagagagcaaaacctaactgtcagcatagacattaaagctcaccgttgattatagctcagggcctgctcagcattgtttaaaaagggtcactcacagttttgtcaaagagtgctggtgttctctatgaactcataaactgttttatctgaaaaggtgattttctaagtagtgtaagccatgggtacatggtgcaaaaagttcatgttctcactcagctggtgagcgaaggatgggagcagagaacagagctaaaacccctggttttcctttccccagatgtaaagcctgctagctggaactcacagaagattggaacaaaaagataggagatggacacctgngggactgctccagcacgaagggaagcgatgagcatcacacagcag

SEQ ID NO: 1270 - DNA, 570 bp, Homo sapiens
  misc_feature 225, 226, 227, 228: n = A,T,C or G
ttttttttttttttttttcagggccaaatgttcccctttattatggttcactcagttcccaaagacagacacattggctcaggcagctcaactgccagctggggaacatccagctccagaaacagggagcagcagcggccccaggagaatggcaaagcaggtcactgggcccccagaactgacctgggccctccttcacccgaccccaggccagaccttccttcnnnntttattgtgtgccctgcccccccttctcttcctgcttctttcccctgctttgtccttcctcgcctggctttccctcttctcctcccctttctcttcttctccccccctcctttctttccttcctctccttcctctctcttcttcctcttttcctctcctttcctctctccctcttcctccttccttcctctctcctttctccctctctttttcctttttttccctgttccctcttctcccttctccctctctcccccttctcctttcttccctccccccctttccctccccccctttctcttctcttttttctctccttctcaccttccagaaaaaaaaaaa

SEQ ID NO: 1271 - DNA, 1261 bp, Homo sapiens
ccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagcgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctggtcagcatgtactcccctcatccgattcccctgtatcagtcactgacagttaataaacctttgcaaacgttcaaaaaaaaaaaaaaaaaa

SEQ ID NO: 1272 - DNA, 1271 bp, Homo sapiens
gccgcttacttctttacctatttacttgtttattcattctctcttgcttcactcattcattcatctggtcatttattatacaatgcaatagataccagtgaaacaacctctcaacaacaacagcaacaaaactcagaacattcacagtatctttggcattcctgcttcttctcactgagtcaccaaccaaggtacacacagcccacagtccagaaacacacacaaatggcggatgcagagcagagacacagtgaatgttaagtttactcccagatccttctggggctcgcgtcctaaacatactgggggcagatctgagatgagggcccacgttccccaggccccctgggcaaggcaagcgccgcctgttctgcccctctggaccgtggtgaatgaccatccccatgagaaacctgtttcaagaccccagaatacatagagacacacacatggtacatagtctcctggtgggaaacgacggacatggagttcatttttaaataggtggctttgtctgtggcaatataaaaatattttggcctttcaaggcaaatacaaaagaaactacccattaacatggctgagtgtctcagtcccaaacaataaagaacttgaagaggtttagccggaaactttgaagacagaaaatctgcccattatgttttccagacatttcgagggggcgagcggaggtcattggagcttgaagcccatttggaaggctggtccctcggcctgcgttttctccttggccctttgaagggccccccagctcacagggcacttccatcctagtctgccgatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1273 - DNA, 410 bp, Homo sapiens
tggcctgtcgaatatttactccactgacgttatctacagaagcacttggccagtttgtacacagtgattccttatgcacgccgaaagggtttccgtaaaaatgacattatatacaaatctgtacacccatccaccagagcgattctccagctcccagagggagttatcaacttaaagcaggatacctgaggtttcatgtctttagttgccttatcataatcccaaatatacatttcagggtttgtttttgtttttaaagacactttcctggaatatgtgcactatggttaaaattaaaaacaaaagtaataaaataaaataaaatgatcgctggaaggagctgaccctccccacccatctgagagacttcatctggctgcagcacagtgaagactgtgtgtgtccctgga

SEQ ID NO: 1274 - DNA, 2057 bp, Homo sapiens
aaaaaaaaaaacacaggcttgatgctcgctcccgtttctacaggaggttttgacggctggatgctgcagggcatcccctcgcctggaggaggttcacttgtggccaggttcccagcacacccacttgctcactggggccctggggacaccgccacactcgagcccatcctacggcctcaatccttaccagtccccaggccatggactgccacactgtaggtcttcaatcaaggtttagtggagtttcgaatgtacacacaccctgaaagacagcgaggccacctcagaaaacaacgcgcgcccagctggctcccctccgacagggcccacggctactgggtcggcctcctccggaccctgagcacagcctggtatgcgtgcgggctcggaatacggatctgagcagaagaaatgcgagtggagagcggttctgcgcaggaaagaggaattttgttggaaagcctgtcgacgttgctagaaaagaccacagcatctcacgaggggcgtgcgccgggaaaccgggagttgacggacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 1275 - DNA, 2546 bp, Homo sapiens
gacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagaggaatgggtagctctcgagaatctagaggtggatgggattcccgggatgacttcaattctggcttcagggatgacttcttagggggcaggggaggtagtcgcccaggcgaccggcgaacaggcccccccatgggcagccgcttcagagatggccctcccctccgtggatccaacatggatttcagagaacccacagaagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatattt

SEQ ID NO: 1276 - DNA, 709 bp, Homo sapiens
agaccaacacagcctggaccaccacagccaccccagcagaggccttatggatatgaccagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactccctcaggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagatttttcctctgcatttacacacac

SEQ ID NO: 1277 - DNA, 820 bp, Homo sapiens
  misc_feature 572, 687: n = A,T,C or G
cacgcttaattcactttatttttcttgtataaaaaccctatgttgtagccacagctggagcctgagtccgctgcacggagactctggtgtgggtcttgacgaggtggtcagtgaactcctgatagggagacttggtgaatacagtctccttccagaggtcgggggtcaggtagctgtaggtcttagaaatggcatcaaaggtggccttgcgaagttgcccagggtggcagtgcagccccgggctgaggtgtagcagtcatcgataccagccatcatgagcagcttcttaggcacaggtgcggagacgatgccagtgcccctgggtgcagggatgaggcgtaccagcacagagccgcaggggcctgtcaacttgccaagggacattttggggcttgcggatcttgttcccccagtagcctctgcgcacggggacgatggagagcttggccaggatgatggccccacggatggcggtggcacctccttggagcacttaacacccagaccgacgtggccattgtagtccccgatagcaacaaatgccttgaacctggtgcgctggccggcacggntctgcttctgcactggcataatcttcaaaacctcatccttgagagaggcccccaggaagaaatcaatgatctctgattccttaatgggcagggagaagagatagatctcctccanggacttgatcttcatgtccttgaccaagcggcccagcttgtgacgggcatccactcttatcctgggccttgctccgcaactccgggcctgggcccggcccgtacacggcgcgaccccggcccgatgccatgcc

SEQ ID NO: 1278 - DNA, 666 bp, Homo sapiens
gatcccggtgccagggaccctgcccagttccaggcgtcgcctaacccagaaacgactgggcgccgcgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgcggaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaa

SEQ ID NO: 1279 - DNA, 1623 bp, Homo sapiens
gctggtttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaagactggcaaaaaaaaaaaaaaaaaaaaaaaaaaaa

SEQ ID NO: 1280 - DNA, 5238 bp, Homo sapiens
gaattcggcacgaggtcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctggggcagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagttgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgcgccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgaggccctccctatgactgggaactggcccaggggccccctgaacccccagaggaagaacggtctgatggaggcgtccccagagcagcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgctgtcggacgcctgagcctcccagccctgcccggctgctctgctctcgttaccgaccactaggggtggcagggccgccccggccatgtttacagccccggccctcgacagtactgagccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccacgggctcaggcgagtttctagaaagagtctatataaagagagaactaacgccaaaaaaaaaa

SEQ ID NO: 1281 - DNA, 792 bp, Homo sapiens
ggcgggcctcgcggatggcggcgcagggcgtagggcctgggccggggtcggcggcgcccccggggctggaggcggccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggccccctcgccgtcttccagatgctcaagtccatgtgtgccgggcagaggctagcgagcgagccccaggaccctgcgtgcgtgtctctgcccacgtcgagcgtgcccgagacccgagggagagacaaaggcagcgctgcctcgggggagtattggccctggcggaacgcagcaaccacgagggatccagccagaggatgccacgccagccagcgctaccaggctgcccaaggggggcgggctgggaagagccctacgcagggcagcacctaggatggggcagagacttgtcacatctttgtccccagcaaaaggctacatgtttacctccttcagttgataataaaccctttctgagattgcaggaggggtccagcgtcaaacaaaccaaacaaaaaaaacttccgagggccatccaatgccggggtgcgcggcaaacacaggaggctcactgggacatgggccccgggcccataccctgttccctggccccacttttcttgtcccccaacgggggcaacaatctgcccgccccccataaaggggagccgatataattcggatagccaggtaacgtag

SEQ ID NO: 1282 - DNA, 1093 bp, Homo sapiens
gcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccagtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaaaaaaaaaaaaaaaaaaaaaaaaaaaaaaaaa

SEQ ID NO: 1283 - DNA, 880 bp, Homo sapiens
ggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1284 - DNA, 1549 bp, Homo sapiens
tggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggagggcaggtgccctctgctccccagtgctacctctctcttccctagggccttttgtggattgacagtagtcccctccgtaggagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaaaaaaaaaaaaaaaaaaaaaaaaaa

SEQ ID NO: 1285 - DNA, 2353 bp, Homo sapiens
cctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaaaaaaaaaaaaaaaaaaaaaaaa

SEQ ID NO: 1286 - DNA, 1499 bp, Homo sapiens
ccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaaaaaaaaa

SEQ ID NO: 1287 - DNA, 1093 bp, Homo sapiens
ggctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccaattgc

SEQ ID NO: 1288 - DNA, 986 bp, Homo sapiens
  misc_feature 974, 976, 977, 978, 979, 980, 981: n = A,T,C or G
ggtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatggccagtacagtggtagcagttggactgaccattgctgctgcaggatttgcaggccgttacgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcatcgacgaattatgcttttaaatcatcctgacaaaggaggatctccttatatagcagccaaaatcaatgaagctaaagatttactagaaggtcaagctaaaaaatgaagtacactgttgatgacattttacgttcgtattagttatgtatatgagtactaagtttttatataaaaatggctcagagctacattttaaaacatgatttagcacaagctaaatctcaaagcctggtatacttttcttgtgtcacttcggggatcttaactcagatataggtacgacaaattgcggcattaactcatggggcgagccacacttttgattgaaattggctcttatcctttgacgaaattgggcgcatgtctcactttcagggcagcgcggatagcggctgtctttcgggagcgcccctatggtgggccgtcactgggtccacggggaaactgtcgggagcccgtgtagcgcgctctttggaggggcgcgcccacgtcgtgagtcacttatagtctcccggctcgcgaaaaaacacccgcctatcgggagactctcgttgtctcctcttctgctctcttctctgttggaggggaggagangnnnnnncgagg

SEQ ID NO: 1289 - DNA, 1700 bp, Homo sapiens
gcagccgcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctccgagcctgtctcagtagagtactggctccttttataatttgttaccagctttacttttgtgataaaatattgatgttgtattttacactcttaagtcttaaccacagtcagaattatcttaatgtagaattataattttggctcttttaggaaaaaacaaaatctgatatttttccaaacgtattgagcaacaaaatattaatattgtgccatatgacaacaaagtctttcctaaatactccatctgtttagtactgtattgtggaatatttgagttctatttccagacttgaaaacatggaggattttagagatgcctgaacaatattatttaagtagtatgtgaccgagctataaattttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagaggataattatatttaatgtataactatagcattatggtgagtggaatttgacattgtccaaacctttttcatttttgagtgattaaaaatgaaatgtcctttgtaaa

SEQ ID NO: 1290 - DNA, 603 bp, Homo sapiens
  misc_feature 235, 525: n = A,T,C or G
acagtttggcagaagacatgtttaataacattttcatatttaaaaaatacagcaacaattctctatctgtccaccatcttgccttgcccttcctggggctgaggcagacaaaggaaaggtaatgaggttagggcccccaggcgggctaagtgctattggcctgctcctgctcaaagagagccatagccagctgggcacggccccctagcccctccaggttgctgaggcggcacgngtggtagagttcttcactgagccgtgggctgcagtctcgcagggagaacttctgcaccagccctggctctacggcccgaaagaggtggagccctgagaaccggagaaaacatccatcacctccagcccctccagggcttcctcctcttcctggcctgccagttcacctgccagccgggctcgggacgccaggtagtcagcgttgtagaagcagccctccgcagaagcctgccggtcaaatctcccccctataggagcccccgggagggtcagcaccaggaagggaagggnggtcacgggcaaccccgggggcctgggggtgatctctttgtgacaggcagattgacttctggaattgatggaagaagc

SEQ ID NO: 1291 - DNA, 926 bp, Homo sapiens
  misc_feature 926: n = A,T,C or G
ctcccagtctgtgtggtttccccctgacttcttgcactgacccagggtgctggagcgaatccagaccagctcggctacctggtactgagtgaaggtgcagtgctggcgtcatctggggacctggagaatgatgagcaggcagcagtgccatctctgagctggtcagcacagctgcggtttccggctgcaccgggcatgaatgtgcccttcaagcgcctgtctgtggtctttggagaacacacactgctggtgacggtgtcaggaacagaaccggtgttttgtggtgaagaggcagaaccgaggtcgggagcccattgatgtctgagcctgcctggagggcgagggtcggagcaagcggattgggtccttgggcctctgtgatgaggcaggcacacctgtcggtcttggcttgctgctagaactagggccttctgctcgcccaactccacccctacctggacgggcccaggcttggggactctgagctgtgttaacggagaacaagggcaaggagacctccctttgtgctcccgtcactccctaataaaccatgagtctgatgttctccaaaaaacaaccaaattccaccgcccacaacaccttcgtcaactaaccatctcagcggtcacacacaccacactacctcacataaaacacacaccactacgcacccgcgcatcctctcgtgctaacgccatcgacgcaggctcgctcacacacccacggccgtggcatacacgaggcgctcccctcctcgggagccctagatttctcccaagcagagcgtacgtccacctatcggggcggccacacctctctctcaaaatataacagctacagcgatgtaacaagaagcactagtctcgcacagccaagtcggcgtcttacacacactctgacggacgcgccaaattcgcaccactgcn

SEQ ID NO: 1292 - DNA, 988 bp, Homo sapiens
gggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgtt

SEQ ID NO: 1293 - DNA, 603 bp, Homo sapiens
  misc_feature 451, 537, 545, 580: n = A,T,C or G
tttttttttaaaaggaataaaaaataattttaatcatatcaaaaagccaaaccaaagaggaatagctcatggaactgacaggatcctgactcagcggctggtgctcttcctgtgcacaagcccagcactccaggtcccaaggcatttatcaaatcccaccaagatgtttggcttttgcaccgaattctgggtttggttccctgaaagaactcattgatgtaaataactaaaagtgaggtctgggtaccctttacatgattccccagacctcaaatgggctaacacgcttctcttctccagcagtcttcctgtccgtgaagtttccttccagattgttacatggaactgaaaacaaagggagcctcagctggatttaaatctggaggcatgccacaaagtcttccacttgggcattttcgagaagaacccatcagagatcataagaaatacnagaacagaggttgcatagctcgaggtgcttgggatattcattctaggttcttggttcttgagaaagtgggttaggtgggtgcatgncaaggatncaagtagggtcaacctttccaaccttaaacctacntaattctgacatcagagtgctgg

SEQ ID NO: 1294 - DNA, 1378 bp, Homo sapiens
gcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaaaaaaaaaaaaaaaaaa

SEQ ID NO: 1295 - DNA, 596 bp, Homo sapiens
  misc_feature 546, 548, 572: n = A,T,C or G
aacttttaaaatcagaagtaggttttatatctttattcagaggtgattcaactatagaataaagcccttttagcactataaaatccaatgttttgaattttttttttttttgctcagcaatacagttgcattttacaacttttataatcctgaagagattctcttatttggagttttttcatgcattcaggtatttagcatgatgtctgatgtggtcagtaataaaggttgcaatgaagtagtagctatgatcataaccctagaagataaagagatgataagacatttatctaccattcaggaacatcagtattaggaacattaaatatatctctaaggtcgtttaatttgcttacaaatagtcataacattaaggaagtatgaggaaggtttataataaaatcaaggttgtcatccttgtactttaacattttcactgtcattaaaagagcagcaaaaatgtgaaggaaaactaaacattctgcctagcttctaaacatagcctaacttctaaagctggcattaatatgtaaagagtggaagtancncattaattaaatatgcccgagtanactggcatatcaccctggggaggg

SEQ ID NO: 1296 - DNA, 2255 bp, Homo sapiens
gaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggaccccccctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgcccctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatggaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaagaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcag

SEQ ID NO: 1297 - DNA, 1659 bp, Homo sapiens
cgggagatgatcctggcggattttcaggcatgtactggcattgaaaacattgacgaagctattacattgcttgaacaaaataattgggacttagtggcagctatcaatggtgtaataccacaggaaaatggcattctacaaagtgaatatggaggtgagaccataccaggacctgcatttaatccagcaagtcatccagcttcagctcctacttcctcttcttcttcagcgtttcgacctgtaatgccatccaggcagattgtagaaaggcaacctcggatgctggacttcagggttgaatacagagacagaaatgttgatgtggtacttgaagacacctgtactgttggagagattaaacagattctagaaaatgaacttcagatacctgtgtccaaaatgctgttaaaaggctggaagacgggagatgtggaagacagtacggttctaaaatctctacacttgccaaaaaacaacagtctttatgtccttacaccagatttgccaccaccttcatcatctagtcatgctggtgccctgcaggagttttcttcaagatatggtgattgccatcctgtattttttattggctcattagaagctgcttttcaagaggccttctatgtgaaagcccgagatagaaagcttcttgctatctacctccaccatgatgaaagtgtgttaaccaacgtgttctgctcacaaatgctttgtgctgaatccattgtttcttatctgagtcaaaattttataacctgggcttgggatctgacaaaggactccaacagagcaagatttctcactatgtgcaatagacactttggcagtgttgtggcacaaaccattcggactcaaaaaacggatcagaaaccgcttttcctgattattatgggaaagcgatcatctaatgaagtgttgaatgtgatacaagggaacacaacagtagatgagttaatgatgagactcatggctgcaatggagatcttcacagcccaacaacaggaagatataaaggacggggatgaacgtgaagccagagaaaatgtgaagagagagcaagacgaggcctatcgcctttcacttgaggctgacagagcaaagagggaagctcgcgagagagagatggcagaacagtttcgtttggagcagattcgcaaagaacaagaagaggaacgtgaggccatcaggctgtccttagagcaagccctgcctcctgagccaaaggaagaaaatgctgagcctgttagcaaactccggatccggacccccagtggcgagttcttggagcggcgtttcctggccagcaacaagctccagattgtctttgattttgtagcttccaaaggatttccatgggatgagtacaagttactgagcacctttcctaggagagacgtaactcaactggacccaaataaatcattattggaggtaaagttgttccctcaagaaacccttttccttgaagcaaaagagtaaacacggcccagcggtggaaccagccattcctgacaagccagcagcctgcgtcaggagaagggcacctcgccaacccacccacacgtttgtgtcactcaattcaatgtcacacttctgcctcttgcaaaattgctggaaaaaagtaataataatagctacttaaaaaaaaaaaaaaaaaaa

SEQ ID NO: 1298 - DNA, 181179 bp, Homo sapiens
gaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaattaaggcaaacttgtccctgagagatgtcaggatagcacagtatggaaaggccatgcttatcagggctcttatctgagagaatacagtggttatgagcatgactctggaactagacagtctgggttgaattccccgctctgccatttagttatatgatatggggtgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatgagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataataattcacttctgagaggaaaaacttctttggaaaaagcaccccatgaatggaagtctcagcatttgctgaagaacttagttaaaataaactctagacctttttcattgattctttatctcttcttttccagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtaagtctatttcagcattctaaatatatgccaagatggtttcatcatctcctggtttttccaagtcccgtgggtggttcctcctaactatttttataattcagggactgaggggcaaaggaaatccatgccagttccgtgactctgtgttgaagatgtataactttgccattaaccaagactgagagaagaacgtgtcttcaagaatccaatatagttttgacttttccagaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacgtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttgttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactggacagaaattactgccaaaaagagtactggtcaatatctactcactgtttagttgcatttgattattgcgagctagataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggccgaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgctatatttttgacgcttgctttttaaaattggtattcagataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttcttatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctgtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaattttttttttttttttcattagaaacagtgtcttgctatgctgctcaggctggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctgtaagacctacgaaggtaatgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagacgggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgacatttccagtcaagttggtctgcattgcttgttagtaatcagaaaagggaattggattgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtggagaaactttgcagggggacttgatttgaaactctcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccaaaattatttcttctttagctaataattattgaaacgttcaacttcatgcaccacattctacaaagaagttcatagcctcggtctgaaacatcatgtcttagaccttctggtctgaaacgctggataagaggttctacccataaagagctattcgattgtgtttgtgaatccactggtgaacattgatggtataaaaccccatgaggcctgccttctcccttcgcaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctattttttttttgagactctctgcatgttggaaagaaaaagaaacattaaaatagggttcttaatattatagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgatcgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagggatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccccttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaaaaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtcggtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcagacatttttaggttaatctgtacaagaatcagggttgtgcagcacatctcaaatcatagtgtccacaacagtcacgtgagcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccatctacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggtgcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatataccgtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgtttaccatgatctccaccactccctggtgccttatgccccatctacttctctccaaaagattgcctcctaccccaaccaggatttgttaagaagtctctaattccaaggcctaatccggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctcagctttggagtgattaacgttctttagaacagattaagaccattctgacagatgcagcagcaagaccagcatctgaggatttgctgagaactacttagcttgggtagcaaagttttaaagcatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatccacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctgacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactctagcctgggcaacaagagcaaaactctgtctcaaaaaaagatacaaaacattagttgggcatggtggcgggtccctgtaattctagctactcaggaggctgaggcaggagaatcacgtgaacacgggaggtggaggttgcagtgagccgagattgcaccactgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttacggaattatatactctatacccagtctctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttgacagttttgaggagtaatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacatcgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttttaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccacacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatggtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctgacatcacagggaaatgtttattaaacaggcaaggagggaatgagcctccccaagtctccctttggactggatgagggaaagaccaagtgtgggagggccggggcctggtgctgtgcactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttataatatgtgcacagttagaccacctgctagactaaaactcaaccccacgcctctctcaagtgagacagcttcacttcagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtctcacttactctgtcacccaggctggagtgccgtggtgcaatcttggctcactgcaacctctgcctcccaggtttaagtgattctcctgcctcagcctccagagtagctgggattacaaccgtgaaccaccacatctggctaatttttgtatttttagtatagatggggtttcaccatgttgaccaggctcgtctcaaactcctgacctcaagtaatctgcctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattagggtgttcaaatagctttagctttcttacctactttcttaccagaaaaaaaaaatgagtttatctacgtttattccaggttttgtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgtagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctgcaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaaaagtgttggtgaataataatagcctttgtttcacagcctaatttttgtggttcttatttagcatttccatgaggagcttgcccttcagatggtggtcagcaccggaatggtgagagaaacagtcttcaagtatgcctggttcttctttgagcttctggtgagattcttgcgcgtttgtatctgtgctcaataggccaagagaagcacacagcagaaaggaattgacattttgttcactgagttgcccctgctgaaaacctggggtggtttcttgaaatctaataatctctcacccctcccatccttcttccactaaattgtgttgcttctaccatgaaaatctatcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccaatactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataagacccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaactcagcagacaggagccaaatacagcagtgagttctgaaagccttagtgctgggatggttagcctgcccagaatcaggattggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttagggtttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtctttcccccttttctgcattgtacaagcaggtcaccaatctccatgttgacatttcctccatccccctccgcaggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataaggcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtagcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgaggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcagccaggtgagtgtcccccccacccccacccccgagcgagccacttggttccttctcatataatgtgatgttcgttgccatggcacgctgtcttcttcattactgagttggcatgaatcctacacatcctgtgttttgcagcacgtccctcatgtctgtgccatggacattcctcagacatgctggtttaccttgattcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcaccaccaccaccaccacctcctccaccatcaccacctcctccaccaccaccaccattagctccaccatgaccacctccttcacctccaccatcacttcttccaccatcatcattgtcaccatcatcaccaccaccacctccaccaccatcaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctatatatatatatatatatatatacatatatatatatgtgtatatatatatgtgtatatatatatatgtatatatatatatatgtgtatatatatatatgtgtatatatatatatatatagtttaaaaaacaaactactcttgaagtgagtgaagaggaggcatgtctatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcctcctctctcagtctgggacaagctccttgagttttttgcaggtactatgtactttgctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcctataaaggttagtcttattaatttgacaaaaaatcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttcgatctgacttccgagtaccgccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccataagcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagctatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatatctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaatactgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggaacctgtaatcccatctactcgggaggctgaggcagaagaatcatttgagactggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacacatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgcggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctataggtgatagcagatacataatgctaaacatcaggtttgaaattactgtgctgactttagtgactgagaagtatcagtctcttattgggtaggggacatggggaaatgtcatgtttgacttgacatcacaaacgatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgttttgtttgtttgtttgttttgagacagagtctcactctgttgcacaggctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctggtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcaatgtagggtatagatgtgcagagaatttaactttcttctcccgtgagaaagcagcatcctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccgtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcgctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctccgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttacggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttatgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttctgctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccagctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctatagatgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgcggtggcgggcgcctgtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagcgagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactgtagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttctgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaagtgtggacctaactctagaagtttaaaatggccattcgctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccaggaacccaagaaactcaggtttccttccatcatagttgtgatttcaccagtgaatgcgacctggctcacagtgcagttgataacacagctctgacccttttagctggacagttcattattaaatctcaagtctactccattgcttaaatccatcttctgattcacatagctcattatctttatggaataatgcattaactcttctaggctttttgcttgtccaaatggacatttgcatatttcaacggtccagaaagtgtatcaaactgccaagtgatgcctaatggccctttatgtctctcctagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctatcagtgtgtttctaaaatagacagccaggggccaggaacgatggctttcacctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccatttcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgagacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattatagaacagtcaagtttgctttagtttgtctagattttgataccttctttggaatttccatttgtggccatgttaataagtatgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaagcaattctcctgcctcagcctctcgagtagctggaattacaggtgtccaccaccatgcccagctaatttttgtatttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtttgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacaccgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccatcactgtccccagtctcaatatgctaacagtctatttggagtgctcagtctcaaaacaattaggaggcagtacaagacaagtgatacataagtgcaaactgtgtggtaaggagctaaatgctatggaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccgtggaactctagcctgtcccatttgtcttttaactccagctcctagcctgctctatggtagggtcttaattaagtgagaatgaatgaatgaatgttttcttttattcccttagtctgagaaccctatttccggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctctagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaactcctgggctggcgaagatgaaaactacagagtcaggtctagatgactccgccatccctagtctctgctgccctctgatccaacccttcccatggcttccccttgcatttcaatgtaatcctaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtaagctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacactatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaaaatagacatcatgttatcaggtattttttccccataaggcttttactaagtactatttcttggaggtcagcacagcttaaacatggaataaaaatagttggactaataaatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtgatactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattattccgacatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgaagaaggtgaaaaggaaggcagaagaaactgaagtgtgagggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcacagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgctaaccaggccagaaggcagacagcttttagttcacaagccaactctgatcagttagtagtggctgactggagaactatgcttaagaatttcgagactatgtccaagctctggggaaaaagtgctacagttgattagttatgcctgccatgattacagcaataggaaggagtggcatgtgtgccacctgtttgtaatccctaaactgggaaggtttcccatttcttctgtttttcatatgcatttcttccatagctgtgagctaggaagaaaatgattcttgacctgtcacatattcactgccagggccagtgctagggtgaagaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaacaaaaacacacacacagtaactgctgcaatgccatgaaaacttccttaatgaagacagcctcgcttgctgttgtcgtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcggggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacggtcagtgcccagagggcatcccggggcctggcctcccatactccagctggacttggggtgctgggaacacctggtcttaatggcccagtcagccccacttcccgaggacacgtgccagggtgtgcggggcaggggatgggcccggggaggactttgatgtatgcaaattgcatgagcttcccaagggagctgagataacctttcatcacagtgccgatctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactaaaactgcctttctgaattgctgttagtccctgctaccaaacttctctcctgttttttcttttcgttttgttttgtttttgtttttgtttttgaggcagcgtcttgccttgtcacccaggctggagtgcagtgatgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctcctcaggatgacataactaaggagagctttttatattttgttcctcaggatcataagagaatgtttggaacctacttccgagttggtttctttggatccaaatttggggatttggatgaacaggagtttgtctacaaagagcctgcaattaccaagcttcctgagatctcacatagactagaggtaagaaaagtgattctgtgcgcctgacctggtacactttacaaaaacaagttagagtgggtcatcaccaaaaataaacaaataaagagttatggattcatcattgatctctacataaagttttcccctttgcatttataaaaggcaaagtagaaaggtattaggtgagatcatgaggtgatgtaatattttgatagtttttccctaatactctgtgtatgcttttcacagtttggaattttatatggtgaatatttattttgaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccgggatcactgtgctgttgggggaatggtaaaaacggcttgggtttgggtttcctcactttcacaagagggtatgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattgaatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaatgagagtctgaacccagagttacaaccagatttcattatactaagtcgtgatttacagtctgaggtcagtgaccccactcatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccgttgctgagtagtattctgttgtgtgactacctcaccatttgcttgttaattccccactggagtgacatttgggttgtttctagtctttgttatgaataaagttgctggagacatttgtgtacaggtttttgtatggacataagctttcatttctctcctgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttaccttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcgtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccacacccatggttcatcagtttctccattatctaattagattgggtcattaaaataacaagtataacaggcataatcaagttggtgaacaaacacagatgaattgtggtgaatatatacctcatcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatacagagagatatatattttgtaagagacaggggtcttactttgttgcccagtctggtctcaaactgttggcctcaaacgatcctcctacctcagcctcccaaggtgctgggattacaagtgtgagccactgcaccagcctgaagttttcttggccttccttcgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggacaccagtcatattggactagggcttaccctgctggcctcattttaacttgattgcctctgtaaagaccctatctccaaagaaggtcacattctgaggtactgaaggttaggacttcgacatatacattttgggggaacacaattcaacctataaaattcagaaaagactctaccccaaaccagcagaacttagcaaatagattgattgacccttaaaagaattccatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggccgaggcagggggattgcctaaggttgggagtttgagaccagcctggccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagaggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcaggtggcctctctgtcatagctccaggcttgtccatagcttatgagaccagacagtgacttccctatgtttacgtctcatgttcagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcaggtaagcaaaaccagaggtggcagctcctctggttcttattatttaggttgtcattatacgtctgcacccttcttccttggggttgatgaggactttgatccatagacaaacacagaaatgttcctacacttaacctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcacgcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttcttaggctacttcagacaagactagatcttcctatcagacttcttagaacgctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattgataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttctcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagattgggggcttaaaaaaattttttttcatatatttttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatagaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgaggctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccagacttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatctctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccctgagaagttacctaccctcggtttccccagatgtaaaatcggaataataattgtacctctcccttgcagttagtgacagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaagaggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatcacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcagggggggtgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagctattaatatgtttttctttataaaacatcacatttattaattgctgtgtaacaaactacctcacaatttagtggcttaaaagaaaatttaattattatgcatgtggtacataataatttttgctttcctcatttctactcctgatacttgcctatgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagctgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctggtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccaggtttaacggtccacaagccagataaccatgatgagttctaaagattttctctgtctttaatgttcttcagttttgtcatgagaagactggatatagctctgttgttgttcattagaggatttatatctctcttcaactctagaaaattaccagctgttatctctttaaatattgtctccctctcattttccattcccttggagattctattagatgtgggttggatcttccttatatctctatgtttcttaaccaattttttcatatttttttattttttaaatctcattggtgatttccttggatctgtcatacatttacttctccaattatgtctagtctattatttaacctttaacctttccattgagttttttgtcttttagcaactgcatttttttttttttttttttttttttttttggtgagacaaggtctggttctgtcacccaggctggagtgcagtggcatgatcttggctcactgcaacctccacctcccaggctcaagccatcttcccacctcagcttcccaaatagctgggactgcagtcacctgccaccatacccagctaatttttatattttttgtagagatggggttttgccatgttgcccagtctagtctttaacttgtgagctcaggcaatccacccaccttagcttcccaaagtgctgggattacaggcatgaggcaccacacccagcctagtgactgcatttttcttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaacattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgctagtaatgaacgatgacttagttcggatatttcagaactttttgtttataccatcaggtatgcatgaatttataatctgaaagaggacttaaaataataattaaaacttaccagcttaagtgctaaactttttattttttaggtatttggggaagaactctttttaaagtatacacctaactgctttttaaaatgagtacacatgacatactttaattccatatgtattcccctactctttgggagacactgtgttgagaccaaggtcaaaaaacgtggtcaccgccctccaaatcgtctccgttccctgaggaagatcatatacctgtgtagtagccacagtacaaaacagactagaacacagcccatagcatgtaaccttttcctgactaactcaaggataggccaacacctatggtattagattctgccctaaaacaataagagttagatgctaagttatatagtcctggaccttaactcaaatagccagaatagccctagtaacctagaatattcctgattaaatatcccctgcttttagatacctgttgtccatttgggtttgttttttacagtctcttttgtaccacagtggatacatttgcttcatgagtgcaggaaccatgttcactgctgcattcttacccctagccctgcaacaaacacacaaaagatacccaataaatatttgttgattcactaaatgaatgaatgatgagtaggcctgcttctagaagtgcactgccaataagaatgtaatgcaagccacatatataattttaaaaattctagtagccatattaaaaataataataggccaagtgcagtggctcatacatgtaataccagcagtttggaagaccaaggtgggcagatcacttgagcccaggagtttgagaccagcctgggcaacatggctaaaccccatctctaccaaaaaagatataaaaaattaaccaagtgtggtggcatgtgcctgtagtcccagctactcgggaggctaaggtgggaggatcgcttgagcccagaaggttgaggctgcagtgagccatgatcgtgtcactgcactctagcctgggtgacagagtgagaccctgtctcaaaaaataatcagcatcataaaaagaaaccagcaaaattaactttactagtatatttaacccaatatatataaaatattatttcaatatgcttccactataaaaaattattttacagtcttttatttccatattaagtctttaaaaatctgatgtgtagtttgtacttacagcacgttgcagttaggactggccacattttaagtgcacagtagccacagggggccactggctaccatattggatagtgccattctagaagctttcagctttttcaactggatgcctctgatttgtggactcagaatacagataaccaaagaagtgggactagtgtctgaagtaagaatgacagggtatgattgagagccccatgagcttacctaggagagaaacttgtggggttgcagaataaggatttgtcaatattggctctagctgttcacactatttctgggccaactcccagatcatttctcaactccagatagttaagtggggagcatggctgcactttttaaagtgatggcacaaaaaaagatattgaacgttggtcctctgattatatattctaaatatgcagttagaaaagaggccttttaagaatccctaagagtaaagcaaattagtatctttgtttcctgaaaattagagaaacttgatatgccatgatagccctcttcattttatttggaaaactcttctatgaaagcttattagagaaaattttctgattagcttcatgcctcccctccttcagcaaggtcaagggtgcagttgtcactatcacataagaatctcataaaaattaaacatgaatatactgcacagatctgattgggtttgtcatgccacacattgttttaaattccataattctattctataaagagtggtttctatgacaatagatcgttttaaaaacaaacaaacaaacaaaatttagagttgtcattggtaattgtggttgcaagtatgctttcaaagaccagaagcttttgttttgctttgaatgtaatttttttcttttttctttttgatacggagtctcactctgttgcccaggctggagtgcagtggcaccatctcagctcactgcaacctccacctccgtggttcaagcaattctcctgcctcagcctcctgagtagctgggattacaggcgtccaccaccacgcctgactaatttttgtatttttagtagagatggggttttaccatgttggccaggctggtctcaaattcctgacctcaggtgatccacctgcctctgcctcccaaagtgctgggattacaggcgtgagccaagcttcaatattcttaaacccaacctcacacagcctgatttaaaaactaaatttctgctaggcacggtggctcatgcctgtaatcccagcactttgggaggcggaggcgggcggatcacgagctcaggagatcaagaccatcctggctaacacggtgaaaccccgtctctactaaaaatacaaaaataaaaaaattagccgggcgtggtggcgggcgcctgtagtcccagctactcgggaggctgaggcaggagaatggcgcgaacccgggagacggaggttgcagtgaacgcagatcgcgccactacactccagcctgggcaaagagcaagactccgtctcaaaaaaataaataaataaataaataaataaataaaaaactaaatttctggccaggcacagtggctcgtgcctgtaatcccaaccctttgggaggccaaggctggcagttcgcttgagcccaggaggtcgagactagtctgacaaacatgtcaaaaccccgtttctacaaaaaatacaaaaattacctaggtatggtggtgcctgcctgtagtctcagctacttggggggctgaggcatgaatccaggagttcaaggctacagtgagctatgattgtgtcactgcactccagcctgggcaacagagtgagaccctgtctcaaaaaccaaaacaaacaaaaaagaaagcaaaaactaaatttctgataatcactaagtttttaattatgaaattactagaggaaatgcagcatcaccttggttgaaaaccatttggagagccgtgcacattcctgatccctaagtccttgatgttgcacccatcttgaggagcagtgctctctctggaccgatgttactgaatccaacccagttcctacttgatgtttgtggcattagcttggcagctagtttttacgtttactatttttactacatattaggagatggcaaattactgatagccaggataagggaatgattttcaaggcattatagctctaaaaaacaattgagaaatcagctccctcatcacttccttaatgcaatgagagaacacgacacggatgaacaaactgttctgttatccaacaagattatcaagagttattagtgagataataaaaaagtatatgtgactgccaaaagtctccagactaaggaccagaagacctggtttcttgttctttcactttctagtcctgcaattctggcgaagatactatactgctctgagcttcagggtttttttcactgtgaaagagggtgcaagttcctccacattcttccaatctactgaggaaacccaatgagataatgcatgggaacatgttttggaaactcaaaagtgctgcccaaaatgtaaggtaacactgtttacaattgacacttccagaaagtttagccagcacccccacacatggcatccgcttctgacaacgttaatcaaaatcaggccaaaggtgcaggcaggacagaggcctgacttaccagaaaataaacgtctggtctattccacttgtagtgccagtttacattgtctggcgagagccaactaccagggcctccgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaaacccaacctcgccaggcttccctgtctcctgtgtgcagcatgtgtgcagtgcattcccctggaaggtaaattcgcggagtcccgcagcccacctgtgtccacctagcctgtaagtgccccctgagggtatcaaagcacgcggacttccgcctgaagcaaagccaccgggcggcaagtttccccgttaacaacaacgaagacagagaggacttggcagctgtgacggatctgcaataattaaactgacgttgctgtttagaagcctgggggtcgcctgcagcctcccaggctccactccatcggctccagcgctgcaggcgggccgtgcatgtctctagatgcatattaagcaaaaagtttctaaagaggatcgcgtggaacccagcaattgattaagaatctcaatggccctaatcccctgagaattgaactaagggctccccagcaaacacagcgatttacatggggcctagagagagcgagcactgccgggggcggcggcgaagggcagcagtggtgggacgggcggggtagggggagttactgagcatgcgcccgggtaggggcgtgggggagttactgagcatgcgcccaggtaggggcgtgggggagttactgagcatgcgcccgggtaggggcgtgggggagttactgagcatgcgcccgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttcccccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccctggatctgatcatcaattatatcatctcttccatctgatggactgcacctcaccccttgctttttcagagctggcgaagctgggccaaggaaagcgatagtgccagctgagtggaatgtgcaggaagggaccgaggaggggcactatgtactggagaaaagagatggggtctccaggacaggggtaaggacactagactgagggcacaaaggaaggaaaccacaaggaagtagagtagggaagtggggagcatgctgaggagagaggtcaagagatggtgaccgctctctgcatgccccaaggagatggtgatgacactcccaagtccatgtgggactccctccttatgcgggcctcagtctgtcatcttccttggagcaggaccaaagtaaataagataaagtcacaatttctcatccttcttcactcaacttttctttgaggtgagttggcatttttgtaaaagaatgcattctctgccagatgcggtggctcacccctgcaatcccagggttctgggaggccaaagtgggaggcttgattgaggccaggggttcgaaacctaggcaacatagcaagacctccatctctgtaaaagaaattagccaggcatggtggtgcatacttgtagtcctagctacttcggaggctgaggcgagagaatcgtttgcacttaggcattggagattacagtgagttaagcgttctcctgtactgccatggtaggtgggtgttgctagccacatgaggatatgtgagccggtcaccagggactgcggctgactccccgagcacaaggacagtaagaataaacctccgattattcccctgcccccaaccccaacttcaattaaagagatatacccttatgtgactgacaaaaaagagccctgctctcccagagtcacatccccatacgccaaaacactcttacatataattattggtgcttcataaatggctgataaaaaaacttttctatcagggaatacaccctaccttattcacagcctcttatagagagctggcctgcccacagtctctgtaaggggcagttgtctcttctgagtgaccagtttccctgacctcccctcaagccatgactgaccaaggaagtcaatgtcaccactgagaagcaaggcgtagcctcagactctgagtttctaactctttccactttcctaagatggggttatgcctcatttctgagagatttccaaccctctgccatatattcctctttttgtgaggtcacttggggaggtgtctgcttcttagcaccagaagagctctctcaggacccagttgctgacccagttgctgcaaatgctgaaagtaggaaatggaggtcaagtgtaggccataaagattttcccactcctcctcttgaatcaggcatggccttgtgaattactttggcccatagaatgcggcaaagtgatactgtacaagttctagccttggtcttaagcctgccagcttttgctttcactcccttggagccctgagctagtatagaaagagatccagctgcaaggactggttacacaatttgcagggattagtgtaaaaggaaatgcaggtttccttgttttaaaattattccgaattttaaggcggtgacaacagagccctataccaagcagaggcttgatccgagctggtgcaggcatgacagccaggcttcctgatacatgagtgatgctatcttggatttctggccccaattcagcctcctaatggtcagcatgagagcatgaactaccctaggtgagaccagtagaagaacccagctcagattacaaaactatgagcaaacaaacggttgttattcaagtaaagctcactaaagctcttcatgacaaacgggtatagtcatgggggccgctaaggcctgggttgagattttatatagcaataggtaactgaagcatgaagaataagagtttgcagtgagtggtcacccaccatattccaggccctgtgttggtgcattgcatgtgccagctcacctgatcctcacaacacctttcataattcctttctacaggagagaatacagcagttccaaggacaagggattcgtaccactgctcctcactcagtaaatagcagagacagaatttgaacgtgagtctgactgattccaaaacccatgtaatatccctgcattgaaacagaggaaaatccaaggaaagtgcacacagcttggagactattggataggggtctgattcagtctttcctaaatttcctcataaatttgcagttgaagtatcaggcagagaaatgataaccaggtgaaagacccctaatgggacatcatgacatcacagctctgtgatcatcaaccataatccctagagggtcacctagagttatcctacaatgaggcttacttgggttttctgataggtataatactgagaaaatttgctatggttagctatgggtattcaccacttattttagtgtatatcatcccccaacaaaccacaggcacctgtgatcatctgggtatgtgttcaggaactatcttgcacccagaaagaacaagaattttttttttttttttgagacagagtctctctctgtcaccagggtggaatgcagtggcacaatctcagctcactgcaacctctgcctccatggttcaagtgattctcctgcctcagcctcctgagtagctgggactgcaggcatgtgccaccacacctagctaatttttgtatttttagtagagacagggtttcaccatgttggccaggatggtctcgatctcttgaccttgtgatctgcccacctcggcctcccaaagttctgggattataggtgtgagccagtgtgccagccaagaattaatttcaacattagactcagccagagttaatgaagaagctttccccacatgatggctcctcacaagaaatactatctatttataatattcattggctttacttgtctttaccaagccttcctgagtgtcatcagtgggtgagtgagtgtatggataggtacctgcctatctgtctgcccatggtgatgaacacatcactgtaggtcagcaatgacattgagtctaaatgctgttggccataaggaaaatagtgacattccctggctcagaggaaatgctggtaggaaagccatatggactagtatttataagtacaagctcaggggtcaaagatgctgaagttcaatgccttgtcctgtctcttactaattagtgatattggacatattgattaattgcataagtatgtttctcacttatctataaaatgagatgtatgagggctaaatgaaatgatgcatgtgaaaaactgaacaaggtgccaggcctaggacaagggctcaataaatgtcagcgattattttatttgatgaacaaaagaaggcaaatgttctttctttgatgccccctatcttttccctgtgtcgtttctctaaaaaagtatatgtgtgtaatttctatgccttccctccactctcccattatctaccacttcatcatcctctcactacccatggccactttccctcattatcttttctatatttcttccctcctcccctgaaatggggttgagcagggggagatcagaggatgagaaaaggcagggagacattggtggcagggtgacaatggagcaccacaagctgtctaggccatctagactttccctgaggacacttcagtatctctgagaataccattttctcaggactcctcacactgggagaaaccttagcaatcatctgatggtgtacttgttacagtagataggcagacatgtgcagtgcaggagagggccccccaccctgaccaggaatgtcaggtgaccatcaggtgatggtcacatggttgttacaccgtctctctcaaataataactggttgcagccagcaccagggaaaggcagtctccaaatagataggaaaaacctgaaagtgacaatcagcagcttcacaataagatctcaggaattgggcaggtgggctcaagcatgtgcactaagaggcaaagtggcggagtttaattggtaaatgaccttcctgtaggaatgctacgctggtaagggaagaaagcctcaagaaagcatctgtaccattccagcaaatacactgtgcatgctcccctcccaaatgctagcaggccactgcacatatggacagcccaccccaagggaagaattgggagaagtaacccaagaccccgaaagtatgccaacctgtaagaccgcaagtcaaaggtcaaactgtgcacttgatctcacaaggtgcccactcggccctcttccaaatatactctacttcctttcattcctgctctgaagctttttaataaattttcactcctgcttgaggactaagctctgatcttttcttatcttccaaattcctatctagggggtctggggagttatgccctacaaaccaaaaattctcatcagatgggttttatttaaccctatatattgtgactttttagtctgactctggcataatattacatgacaaaatcaaaatattttatcccataacatgtctctttggcatattttgaaatggccctgcaaagccatcctttgtaggggaaaatttgcatctgtaaagaatctctgttaacatagctagatatttttcttccaggcgctcccatctgaagagattaagagtctagcacctttttaaaattatttatttatttatttatttttgaaacagagtctcactctgttgcccaggctggagtgtagcgtcgccatctcagctcactgcaacctctgcctcctgggttcaagccattctcctacctcagcctcccgagtagctgggattacaggtgcctgccaccacacccggctaatttttgtatttttaacagagacaagttttcgccacattgaccaagctagtcttgaactcctggcctcactgtgatccacctgcttcagcactccagcctgggcaacaagagcaaaactccatctcaaaaaaaaaaaaaaaagttagaaaactaaactacaaggtccttaaatgcctgctccacagtattagccaaacatgaacaagatcccaggtgttaggccgggcgtggtggctcacgcctgtaatcccagcactttgggaggccgaggcgggtggatcacctgaggtcagcagttcaagaccagcctggtcaacatagtgaaaccctgtctctactaaaaatacaaacattagccgagcatggtggggtatgcctgtaatcccagctactcgcgaggctgaggcaagagaatcgcttgaacccgggaggcagaggttgcagtgggctgagatcacgccactgcactccagcctgggcaatggaacaaaagactccatctcaaaaacaaaaaaaaaatcccaggtgttctggattcccatccaaaagaaaaggggaaaccaaaccccctgcttccatctcacccaggatctcctgtcttcccaaagcactttaccgtctttcctgcccagctgttgaaatatcaaactgtaccaagattttggccatgatggactctgttctctgcacactaagagatttatcttcctgatcatcagtagaaatattaataaataatattggttgccatttattgagcagtgtgttaaacatccatattatttaatggatgtttttctagctgtgttttaaagttttaaagttgcagcatttgaatgaatgaatgacttctgagccaaagtgagaaaaagcaaacaagacacaaatgagttttctaaactatgtgtctccccgaaattagctctgctactttgcacaagtctcctttcctaagatcccgcttctcatctgttcaatggggatatgaacatctacaagtttatggtaaagtttaaaagcacatttgtctgatactaagagccaataaacaatcgttactttcattaccccagttggcaatttgagcagggcatgacagggagtttgggtgacaggcgataaagtaacggacattatggaaagtctgaaagaatgtaataaggataatatattttagatgtatttttctcttttatattttgtgaatgacttttcccctggttagcctaaggtaattcttatgactcagggaggtttgagattgttacagcaggaatgcaaacagaaaaaaaaaaaaaaaagatctagcttttgatttccaaatttgagttcctagaataactgtctttaaaattcagaggttggagataaagaaaaggattttctagattcctatcacttccattaaaataccaagggtcagaacaatgaacctgaattctaaagctattggtagagagaaatgacctttgatgtaagaggtgtccctactgcacagaaaagatggggtgtttttcctttccaaaccaagggaatgtcaggggaagaaaagatagagattaaaggggaaaagtgagttttatgtatcttggcttctccattcagggctgatatcacaagtagtagataaattgaaagaaaggaatcccaaaagaagaaaaagactgtgttctgctcctcacttaaaactcagcaaaagggacccccaccaagtggcccatgccaatatgtaacacagaaaggaaaaccaacagcatgggcctcttggcttggaggaagccaaagtgcacatttcttcagtcatactacatctgggttcatctagccacctctgccatgctgcccaagttcaaccccaatgagatcagtcatatacctgccaggtgccctggtggaaaactgggtaccatgtctgccctagcccttaagatcaaccctctggacctgtctccaaaataagttggtgatgacattcccaaggccacaggtcaccagaagagtcaaaggattacaatgaaactgaccattcagaacagacaggctcagactgaggtggtactttctgcctctgccgtgagcatcaaagccctcaaggaaccagagacagaaagaagcaaaacaatcaagcacagtggaaatgccatttttcatgacactgtcaagattgcatgacagatgcagcaccaatccttagtcacagaactctctgggacccgtaaagagatcttggagactgcccagtctgtgagctccaatgttgatgggcgccagcctcctgacatcatagatgacatcaaatcaacagtggtgcaagtaaatatccagctagctatgaactacgaaggaaaaaatttcaataaaggatcatttgacaactaaaaataaaaacacagcatggttatgacatagggtctgcatgagtgcctttgtgcctccttgaaaaagccagtttccccatgcacagatgtcagtagtacaagtcaaccaggtatccagagacattgctaaaagatgtcaataccaaatctaatcacagcataaggaccagtgtatacaaatctaaagcccactttctcctgctcactcctaaagctcactttctcacaacactgccaccccaatataccaagaaaccatctagaaaggagggcagacaatagccacttacctttaaaaacaaaaccaaactctttacaccaaaacttcttccatatccaaagagtctaaaatacagttagtgatgaatgtggatgtggagccaatgagtaagatttgatcagttacagaaaacaagtgaagccacatttactttgcacaaccaaatgtagtttgctaagtttttgaccccattatatgaagaagacaaatcatccataactctaccacgctaaacatccattacttttttttttttttttttgagagtttcgctttgtggtccagcctggggcgcagtggtgcaatcttggctcactgcaaccttcgcctcctgggtttcagcaattctcatgttcagcctcctgagtagctgggattacagccacccatagatttttaaaatacttctctttcacttgtcttgcataggcatgattattgcaaataactgcaatgcatatcagtcacaattttatatcgtgctctttgtaaaattcatcaaaattccttttccatgctgctgtgtgttcttcctggttaccaatgttaacagacgcataagctattagtcaaaactcttgtcattgcaagtatcataaagccaattccaactcaactgaagaaaatgggtatttaatggaagaacactggagttgctcattgacctacaagaaccacgcagccctgagggcctaaatgcaggggacgggggcttgaagtcaccagagttcttcactgctcattcttcctacagacatctccacataaatgtattaggcatttggccatgttaggtcattttcattagccacattttccaaatggggacggagggactaagggagttagatgtgactcactgcaggtgattcagctgctaaatggcattgatttgaaaaccagcatcttgattcagattggtggatccatacaaattgcaagggacaaaacttttcaaaaatatgtaagaatagtcacataggataagaatatatttgatttttgtgaggactacagctgaaggagaagagaaacatgcaaatggggttccatttcccacaccagggcagcttctgtcatctcagaatgcccacctggcatcttcctgacccttggctcacccacaaggaagttcatggcaatattgttttcagaagccaatattctcctgtctctacttgcaagaaaataactgagcccccccagtaagtataattggtgcgaacagtgatttattatatgcccagttctccagatggcctttcatatggaaatgatttttcctgaaaacagaaaaatatgggttttttcccttctcagcaggttataacaggtttacaatccactgcatcaaaactagaatcaaaaactttaacggagttcccttaaaacagaaacacaaaaaacacgttccatctggtaaataattgccggagttgcattcctgtgcattcaggcacaagctaactgctgtacagcataaagctgtgaaaatgtctaggcttaatggggaaacatgagataagatctacttaggtctatcatatactcaaattgcaaccttctgggatgctggttcatgccagactcaaatcacccataatctgatgggctagacagatgtgtaagattattccaggatatctgaaaatctcacatgtgagtacaaaaggctaggtggacacgtgcagcccttattctatgtgaatgaaggggaatgtttaccaagaaggtcattttcagatgaccatagttgaagagcaaagtcaaatgtggttctaagtgacatgtcctctgcctaaataacagatgagaaagtatatctaaaaaggcttatatcatcctgtgatggaatacttaagaatggggaaagcatttagcagtaaaaagtaagttaccaaaaggatttaatgcagttagtatgtagcaggttaatttcagtagatgactctaagttatgattttcatccagaaagaattattttcgtcagctttccaccagtggaacatacttcctcctaagctccctgcctctgaaagcataggcaggggagccgtgtattagagacgttgtggggaagatctccacatttggaaagctgaagatctgcagattaggggtgacactcaaattccttaaggggttgggcagataaattgtgtaaaatggtaaggcattagaaagtggaccagactgcagaggactggagaggcacagcccacctaaagacattcaaatttggtacagatgcttcttggcttaccatggggctactgtgtcccaataaacccacctaagtgaaaaaatgcatttagtacacctaacctaccaaacatcacagcctagcctagcctaccttacacatgctcagaacacttacatgagcctacaattgggctacatcatctgacacaatgcctgttttataataaagtgtagaatatctcatgtaatttattgaatactggactggaagtgaaaaacagaatgattacacggtacttgaagtatagtttctgctgaatgtgtatggctttcacgctatcataaagttgagtaattataagtcaaaccattgtaagttggagactatctgtatttaaaaacaaaacaaaacaaaaaaaaacccaaaaacaaaaatagactggtctggccaaatagaccactttggaaggacgtggcctatggatcaagaggatatttgccgctcctggactagcaaatccttaagccttctttgcctgctgagttctgtgatgtgtataaaaataatgcacttttatctaataagagccaaacacattaacctctgtggtaggagaaagtggagttgaacagaagtattgaatgtggtctccatcctcagaaaactcaaaactactttaaaataagatatgtccatacaaaggcagccaacaacggcgggcaaaaagctcatgacggctcattaggaagcatttctaactttgatctagatgggttcagaaagagccacagaataggcaaggcttgagtggggcttaaaagaacaaataggtctgacatagtggctcacacctcgatctctactcgggagcatcgtttgagcccaggaggttgaggctgcagtgagctatgatcacaccactgcactccagcctgggtgacaaagcaagaccctgtctctaaaaaaaaaaaataaaggatgaacattcagctaaatggagagtgtataggaggatagagttgttagatagtaataggacaaacaagaagcccaggggcgaggaggagggtcatgcttggatccttctgaacctctcaacttcttcctcagatcctaaaattggcttcctgtcacctattctgttctgagcctcctcctcagcctctggacctctcccttcttatgaactaaaaggtttcttagggtcacagttcccacagctgggccctaccacctgcagtcagagcccttagcgctccccttgtattcgcctggtacatatcccagcctcaccgcctgtttgcagacttgtcaacacagtcattgggctacctcttggacaatcacccttgatgctgaatcacccaagcaaattaattgaattttcaagtgacgagtgtaatcctaagcacttaatggtcagaagtgagggggcacaaactattttcggattcgaatttgtctttattatgtggtgtacacctttgttggggtactaagtgccatcagtaaatagctagcagcaattgatggcttacaacgtgccagaatctgtgctgagcccagggcatgcatgccctcccttgccaactcaacctccaaaatggggcacaatattttcccctctctcgagatgggtaaactgaggctcaggggttaaataacacatgcaaagtcatacaactaacgggcatggattcaaacccaagtcttctgtctccaaaaactgactacaatcacatgtggttgacggttatcactgcatgtgattgtaccattcatatggatgtgtaaatgcaccctcaatggcacagaatcacctgctggcctatcattggatgtaagcagctgccatctgccaaacaatacacgcatttgatgtatgaatttgtatcgctgactcttcagacgcagtagtcctcccttatccaaggtccaaatatatgaaacagaaaattccagaaataattcataaatttcaagttgtccgtgttctgagtagcatgatgaaatcttagccatcctgctctgcctgccggggtgtgaatcatctttttgtccagagtattcacactatagaggctccctgcctgttaatcacttagtagatctgttggttatcaggtcaactgtcgcagcatcacagtgcttgcgtccaagtaacccttattttacttaataatggcccaaagagtaatgaggtcagaatattgttttattatattataagttgttatcctttattgtaccaaatttataagtgaaactttatcatagatatgtatgtataggaaaaaaaaacatagtatatagagggttcagtacaatccatggttttgggcatcctctggggtcttggaacataccccctgtggattagaggggagtatggtaatgcagcattctcaccacatttgaatcatctgggggcactaataaaaaagcactgatgccttagcttcaatccccagagatttagatttaactggttttggtttgaatcaaacattggaatgctagaggagcttcccagatgatcctaatgtgtagagaacataggcagtgaatagttgctaggagtgagggcttggggtctgatttctgttaccataggccagctatgacacacctatgagtcttagttttctcatctataaaatgggaactacagaactgtgtactttatagcactgatgcaagggttaagttagatggaaacaatggaatgcaaaaatggtaaggttcctggtgccatccctaaaagcctcattgatccataatgaaatggaagtttatagtctcttaggcaaacacccattggttatatgagaaaatgtattctcctggctttctactcagactttctgacacctcagggtagaggagagggctggacaggcactcttgacaacctgctagctctttcagagatgtaaatgcaaaggcctttcagagctagacagctgacatacagatgtgaagtaactgggataagctatcagggctatttaaaaaaagggagacagagcgagcaggtatgatttgaagagaagataccccataaaagggcttaaagttcattaaaaataataattactaccaacaaagtgctagccaaacaaatccgtctgtccccacatgcagcaggtagggtgccagtttgcaccacgagtagttcacaccttcagctttagagattcaggtcagtggctcctccctgcttctgcacttgtgagctgagggcagctacttccccttccattggaagccagggggtttcaaggatatgtcggtgactatgaaggggcttgcagatgacagccagatttgttaaaggcagacaagcagttatttgtttaaaagttcccaccttacagagggcccatctctgtttcaggctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctcaagcactgtaagcattgtttctccccttgccctggtaaattatttaaatgacatggttcattctaatacattacctcatccctcctttgaagccacagtcaaaagcattgacaaacaagtttgagagagataaggagaggcaagataaaagatataaagtgaccaaaaagaaaaaaggtagataatttgttccttgtctgttctcaaggatcacaggtctggtggcttgctgaatggggtatggagagggaacacggtacacctcccacatctgtggcctgcagtggccccagtgagcactgggcagcacccaggcagagagaaggactttctggatttctctggggatagttactctcagtgtttccaagaataagaatccagcatgggattcatcccaccttcattgcattttgctttgctttgacatctgccatggagaatgcaaaaaaaaaaagttaggcctcataagacataaatgtgtcaatgctttggcctatccaggcccagatttgagttcagagaggccctggaagcctggactagtcctagaccaactttggttcttgggctttaagaaacagcattcattcacctgattttcaactggggaaccaccctccaccctcactgtcagtcactgtgctttggatgaaactgactttatccctgtcttcagggagtgggtgtggtattcaggcctggccaatcagagcatcacattcctctgatccagtgatagatagtgacccattgagaaatgggcatgtgaacccctcagagtcagagtgatacaaggaaactgtttttaagggctttgttaaggtataatttacataccataaaattcacccatttaaagtatacaattcaatgatttttagtaaattttcaaagtaaccacaaaaatctggtttttgaatatttctataatcacaaaaagatctcttgtgccatttgtaggtacaaggaaactttagcagagttattgaggaaaattcacctgttccttttgtctgggtctgtttgcaataatgattacaagagcctggatctacatagaacctgagaataaagcaaaaactgcttagtaaagagataggctgggcacagtggttcacgcctgtaatcccaacactttgagaggccgaggcgggcagatcacttcaggtcaggagttggagaccagcccggccaacatggtggaacctcatctctactaaaaatacaaattagctggatgtggtggcgcatgcctgtaatcccagctactcgggaggctgaggcaggagaatcgcttgaacctgggaggcggaggctgcagtgagccaagatcgtgtcactacactccagcctgggtgacagagtgagaattgtctcaaaaaaaaaaaaaaaaagaaaagaaaaagagagagagagatgtagagaagctgagtccggaggtccctggttgaggctctgatcaagctgaacctgaagtcagagcttcccctagacttcttcagttccatgagctgagaagtttcccgttgtctttagccagtttgacttgtgttttccatctcttgcaatgggatgaatctcgcctgactccaaaaatttttgaccagactctaaagattagaactggaacctttattaattgaatatcagacaggaaagcaaatctccagatttgctgtaatcaaaggattattttacatatgatcatagatgccattttacaaatgaggattcagccctgcaaaagtcaattgcttaaccaggatacataggagaaactggagaagtccgtgtaactctgaatttgattttgtaaccctgaatttgatcctgtctttcctcttgaagtaatcatcatcgtcgtcatgatcatcatcaccattacctcttacaaaatgtttactatgtgtcagacctatgctgagtacgtactgtataaatattaactcatttaatcttcacaactgccttatggggtaggtattattattattctcattttacagatgaggaaactgaagtctgtagaggtcacataacttctccaaggttatatagcctgtgagtagcagaggcaggatttggatgcaggcacactggctacagaggccacactcttaatctgtgcactgtactgccttttataaataaaaattaatctaacataagcttttaatcagtgttccagtggtctttcagctagagatactacctttttctgaacttatatttccgtcattataaaaaaataaaaagcaaaaacctcaaatattttctgtattttaagactcttcaattatataaacaatttttatctgatttcaagtagtcataaacttctgtgcttcttacaactttgttctgctcttctaaacacagtaaaagtaaagtttaatcatggcaaaagtctaatttttatgtcttcttgcagtaaaaaactagatgactgctctgctttattgatatttaatatgatatggtaatgatatttaatgtaatttaatatgaaattttacattttatatcagccaactgacaagaaagtaagacctggaagttatttttatgtagaagaaagatatgctgaattttaggaaattcagccagtggatatatacaagatggttgaggaggggagctgcaggcacggagaacagcttagaaggctgctcctgcaaatacagacagttcccaacttacaatggtttggcttatggtttttcaaatttatgatggtgtgaaagccatacgtgttcagtagaaaccacactgcaagtaccccataaccattctgtttttcactttcagtacagaattcaataaattacatgagaaattcaaactttattataaaataggtttgtgatgatgattctgcccacctgtaggctaaggtaaatgttctgagcgatttaaggtaggctaggctaagctatgatgtttggtaggttagatgtaagtgcattttcaactcacaatgttttccatttacagtgggttcattgggatgtcataacctcatcgtaagttgggtatcagtacctcagatatatttgtttagtatagggagtctgtacaagttacttgggattgacttggctcctggggcaacagaactttgttctaagttctaatgccattgttaaaatcaatgagtcatcaatagggcactagaggtaattgagaagctgccctattgggaggggtagataactagaaaaacagcagcatgaagtgtggattggagtacttaatggtggcacctgggcaaattattctaggcatgtctgcacagacctcaaatgatggaggtgggttagagttcggcttcccaaatcctctgtcagtgatctcttattgcagaaggcagcctggtacccctaagagtctaagacacagcttcagcggccctttccagttttctatttaaaattcttgtagaatttctgcttcactccctaggaaagcctatgtctgccttcgggatatgtgaaaatttgacaagaagtaaacaccttccctgttcaacataggccccaccttcccaagctctcatttctaggtttcttgttctttggtccatattcattctatgaggagatggtcaacatggctacgaactccacatgaactcagtattaactggttaatctactccatgaatccctacaaatacgggagcatgttggggtatggttcttgggtaatgtgtatgcattttgattgaggctgaggtttttgctgcaatcagtggtctagcctcacaatatccagtgtggtgggaatgtgtggctcaaagaggagaggaggatggagcttctggagaaggaaaggctttggagcaagcagggatattagagtctaacaagtaacagcaagtttcttacacttttgtgttcaacactttgttgctcattcatgctggaaaagaagacaagaaacaagccaaaattttcattcatcctcagattgtcttattctaacttggagacaaaatctggatttgaaccttgtttctgccgtttatgagttgtttgaactcgaacacatcaactaatctcaattacctcaactgcaaaggagcagttctgataacatccttcctgtctcattcacagggttactgggggaatgaatcagtcaatgtaatcaaaaatgctgcatacagacagtgtaaactgtgactgtcttgtaagagtcaagtgtcaataatgactgtcactttgatttggggtcaggattcactcttactgctgcctgttatgtacaatctcaagcagtgttgtttattattattctaagaatagcatagcttttgggtctgtattttacaaaccaaatattgtaattttagggataatggaatattaggggcataatggggaaagttgaaaaattatggtcagtggagagatagttaaaaaaaaagtactggaatagaagttaggagacttcacctagtacctcagtgatctggagtcatcatggcaccatgctgggcctcagtttcctcgatctgtaaaatgaggatgcttgatccattgtttcttaactaggaggagttttggaatcacctggaaaatccccaaaggtagaatttttgttttgtttcttgctgtgtttccaaggcctggaaaagtacttggtgtggggaagctactcaataaatacacatatattttatgaatgaataaactttttcaaaattcataggcctggttccactctgaaatcctcgtgcagtttggggtagagcctacatgtgtattttggaaaggcctttctgatcgttttgccaagtgctcctggctaattaataaccaccaagagccactaaactcaacaatctccaaggtcccttcacatgcagttgccacatttagcaaacaaaaatgcagagcatccagccaaatttgaatttcagataaacaatgaatacttttttagtgtaagtataggtcatgcagtatttggttgctgcaacttaaataaacataaccagataagacttctgcttagactgatagtttgggccagagagtggcaccttgaaactggcccagatttgaaaatcagacagagatagtcttggtttgagtctctgccctgatcttagcagattgcttaacttcactgggctccacaactacagtgtctaccctgtagagttggtgaaagtattagagataatagaggtaagatgcccagcacttagcaggcatttaataaagcttagctattattactattttttatctgctccacggggtttgaagaaaaataatagtatcaatgagactgttattggcaatactgtttactcgtaaattggcacttgaaataaccaagattatagttaacagttctaggtagagcttggcaaagttagattgaatgctgaccttgtattaaacaatacctctatgtctgggggaacaaaaccgtactaagtacagatcatccagaataaataaaggaaggaagtacttttatttcattcattatgaaatgtcatttgcttaactgacttttttgacgttaaagataaatatttgttcaggttttatagggtcactctctggggaaataggctattacttggccagcggaaatacttcaatcctgaccaggtttttctgacttctaagttaaaggcatcttcttcttctagagttttagttgtttctagacattttaaatacatctccactggttaaacaaatagacagtcaggcacagcagttcacacctataatcccagtactttgggagcccaaaaaaggtgggaggattgcttgagctcaggagttcaagaccatcctgggcaacaaagtgatacctcatccctactaaaattaaaaagaaaaaaaagccaggcacagtggtgcacacctgttgtcccagctagctgggagctgaggtggaagaattgcttaagcccaggaggttgaagctgcagtgagccatgattgtgctactgcactccagcctgagaacagagcaagaccttgtctcaaactaataataataataataacaataggcaaacatagcagtaaacataaaatgttcatttaaaaaattatctccagaaagatctatttggacaaaatctttagataatttcattatcaaatttaaaaagagatggctggaaaataaattgccaaagtttcaactgagcaactctgatattggcaaaaatacgttaagctccctatgtttacttcattgctcattcaacacatatttattgttgagcacatattatataccagacagtgtggtaagtgccagggactatgagtaaacagaacaaaattcttgctcttgtggagcttatattctgacacaggaaaacaaatataaacataataaatgaattaattagaatatagatggcaataagtgctacgaaaaaagatgaggagaacaaagatgagactatgtgaagggctaaagtggctttttttttttttttttttgagacagggtctcattctgttgcctaggctggcgtgcagtggtacaaccatggctcactgcagcctcaaactcttgggttcaagggatcctcctgcctcagtctcccaagcacctaggaccacaggcatgtgttaccatgccccatctaatttttaaacattttgtagagatgtgctcttgccatgttttccaggctggtcttgagctcttgggctcaagtaatcctcctacctcggcctcccaaagtgctggaattacacatgtaaaccaccgtgcccactcctggagtgcattttcttttttttttttagacagagtcttgctctgtcaccaggctggtgtgcagtggcatgatctcagctcactgcaacctccgcctcccgggttcaagcaattctcctgcctcagcctcctgagtagctgggactacaggtgtgcatcaccacgcccagctaatttttgtattttttagtagagatgggatttcaccatgttgcccaggatgctctcaatgtcttgacctcgtgatccaccctcctcggccccccaaagtgctgggattacaggtgtgagccactgtgcccggcctggagtgcaattttaaatagcatggtgatagtgggcctctctggggaggtgacatttgtggacaggagagaaagaaggagcatgctgatttggggcgagaaaagggaaacgtcaaacacaaatcacctaaagcaggagtgatatggtttggctgtgtccccacccaaatctcatcttgaattataactcctacaattcccacatttcgtggaaggaacccggtgggaggtaatcaaatcacgggagtgggtctttcccatgctgttcttgtgatagtgattaagtctcacaagatctgatggttttcaaaatgggagtttccctacacaagccctctctttgcctggtgccatccaagtaagacgtgagttacttctccttgccttccgccatgattttgaggcctccacagctacatggaactgtaagtctattgaacttctttcttttgtaaattacccaatcttgggtatgtctttatcaacagtgtgaaaacagactaatgcaaggaacatacctggagtgttccaggaacagccaggaggcaacgtggctggacaggagacagggaagaggagagtagtaggagaaaagacagagtcattattgtcatcataattgtgacagaactccacaaacctaacttccagttttgagtcttagtttatttactctgtgactgtagggaaatccttaactgcttaaatagaatgatagtacttaacttgcaaagcatcgatagttagagatttatttcacaaaactgactagagagaatcagtatagcttagccatgctgtcggtacttacgtggatagctctgggtttatatgctgatttacttactagatgtgtgtccttgggcaggttacttaaacctctctgtgcttcaggtttcctttctgtaaaatgaggcaactaataaatgcatcctttagagctgttaagggttgcctggacaactgtgaggctgtctgtgagagacagtctcacatcacatgcttaacatagtgattggcatatagaaagtactaagtaaatatcattatttattattatttgaaaagtttaagattaaatatattgaaatatgcatttaaatgtatatttgaaatatatatttaataaccaaaacatgcttttgagaaaaaatatcttattgttattaatagttgtggccaggtgcggtgtcatatgcctataatcccagcactttgggaggccgaggcgggtggatcacctgaggtcgggaattcgagaccagcctgaccaacatggagaaatcctgtctctactaaaaatacaaaattagccgggcgtggtgacccttacctgtaatcccagctactcgggaggctgaggcaggagaatcacttgaactcaggaggcagaggttgcggtgagctgagatcgtgccattgcactccagcctgggcggtcaacaagaacaaaactccgtctcaaaaaaaaaaaaaaaaagaaaagaaaaccagctgtggcctggtagccggcctccctgtctctgaatattcacatccttgtacagtcccttcccatattgtaccagggttggtttgtgcgaccatagaatatggcagaagtgatggtatgtcacttctgagattcggttataaaagacattgcagccaccatcttggtcattctttttgtctttctctccatccccacttggtctggagaaaaccagctgccatgtcatgggacagttcacgtgacaaaccttttgccagcaaccatgtgagttgctgagcctccttagaagagtgaagaagccttctcagaagtggatccaccagccctggtcaaggtttcaaatgacagaagcccccagtgacattctgattgcaaccttatcagagactgtgagccagaaccatccagtgaagcagctcactggatggttctcaggaactatgtgaaatgataaacatttatagtctcatgctgctagttttggggtaatttgcttttttttttttttttttggagatggagtctagctctgtctggagtgcagtggggtgatctcggctcactgcaacctctacctcccaggctcaagcaattctcctgcctcagcctcccatgtagctgggattacagctacacaccaccacgcctggctaatttttgtattttagtagagacagggtttcaccatgtcggccaggctggtcttgaactcctgacctcaggtgatctgcccacctcagcctcccaaaatgctgggattacaggcatgagccaccgcgcctggccggcaatttatgtagcaataaatactaatagtttacatacatttttttttcttttgagatggagtcttgctttgttgcccaggctggagtgcaatggtgcgatctcggctcaccacaacttacacctcccgggttcaagcgattctcctgcctcagcctcctgagtagctgggattacaggtgcacaccgccatgccccactaatttttgtatttttagtagagatggggtttcactatgttagccaggctggtctggaactcctgacctcgtgatccgcctgccttgacctcccaaagtgctgggattacaggcatgagccaccgcacccagcaatacattttaagttttcataaacttttgaatataaagaatttattgggctcaagcccaattctatcatttttgatctttaaagatcttcactgatccttggtagtttacaagcattcattttttatataattgttatcagtgtatacatcctacttcatatctgatttttcctcttagaattatttcatgtataccaatagagtacaagattcttagcatttatactggcggtatagaattctcccctgttactgtgtaaccacgctacctccaatagtcccttttgtacctggtttggtctgtgtgatgatagaatatagcagaagcaatggtatatcacttctgagattagattataaaaggcattgtgctaccatcttggtcattctaactttctctctctccccacttgctctgggggaaaccagctgccatgtcatgggcagcactatggagcaatacacgtgacaagccttttgccaacaaccatgtgagctgctgagtctccttagaagagccaagaagccttctcagaagtggatctatactggctgtatagcatcctgccccgctactgtatgtcacaccacctcaaacagtcccttttgttggaatttaaattccagtttttcaaaataataactggcacaataaaaatagtgcaaattagctgggcagtgtagtgaaagttaaatagatcagctctcttagatacataaaacacagataacacagaaggggcaagtcctcttaaagtacatagaccgtgaacaaatattgaacacatgcatttgttaaataagtgagcaaatacaaggctaacctaagacagcaagtgcaaagtaactaggtgaacttacttgtttagataataactttctagaattctgtgtgtttcctagagaaatacaggaatgacagctgacaataaagctttggaaaaatcctgtaagtaattgccttggctccaagtatcaaagcagaatttcggagaaggtcctcctgcactaaagtcattgtccccagactatgagtttctgcctccttctctttcagcattctcctcccctcctctggctgtcctttgtcagactctacaatcatggctagaagaaaaaagttgacttaaccgttctttgttgaaattcgggactatgttagagataccaggtctcaatcaaatacagccttcaataaaagactcttacgtaaccagatcctatgagcagagagccatcgtgcctccaacttagtttcttcagattggctggttttggtgctcaacttttgactttacccaccttcctgacaaagtgttgaggaccactaggtaagcatgctatcttcaacgttaaaaaaaaaaatcatgattgaaggcagctgcacttcatatatcaaggagcattgaatataactaactctaaaacttcatcaggtcatgaggttttattgacatcagtgtatttggcttcagctgtgataatcatgtggcgcagtctcttttcctccccgcaatgccttgcctcccttggaagactccctccaccccaccccagccccattcagcttcgttcagaaaaaccttcatttttatctcccattaaagtttgtctgatgaaaaggctctgaggctcaaatgacagctcagttgtttgaaacctgctgggttagagaatggtgctataaggttaagatcaaaaggtcaccaggtcagggtttccttgctgaggaagaaaagcttcagtgacagtgactcagtgtaaagttatcatcactagcataattaaacacacacacacacacacacaccacaatgcatacactgtcccagctggaaggggtcagggtggacttctggctctggcctccagcaacctgggttcaaattctgcctctaccacttggcactgtggcttcttgcagctatttgaacctctgtgagccccattcttcttgtctgcaaactgtagataataatcatgactaccttacaggagaagtaaattggttcagagaacacacttaactacagtgccaagcatggaagtaagctctcaataagaattattgattattaaaactacattcttggccaagtgcaatgactcacgcatgtaatcccagtactctaggaggccgaggcgagcggatcacttgaggccaggagttccagaccagcctggccaacagggtcaaatcccatccctactaaaaatacaaaaattagctgggcatggtggcacatatgcctgtatgtgccagctactcgggaggctgaggtggaagaattgcttgaacttgagaggtggacgttgcagtgagctgagatcgtgccactgcactccagcctggacaacagagcaagactccatctcaaaataaataaatacataaataaattcataaataaataaatgaaagaaataaaattatattcttgttttagttataacaacattttatatgtctctcaagccaaagtctaatagcattacaagttgtttttgcacatgtatcatctccctttaaaggacagatagtttcttgggattattcttatttttgtcctttatgaagcctaacccagcactttcagcacagcaggccttcaataaatatttggtaaataaataaataaatgttctaaataaagtggatctgcagggacaggtttgtacacataatccctctacttaggatcctagtagaatgacatacacattctgaatgctctataaatattttataatagtaacaatgatataataattataattatgaatgaagattactcttagctcaatttcctgaactagaattatgtccttcagccacggagaaaatgtattcatacagggttccagcttaatgtaaacagaattgtaacttgatttttaaaataactaaagcaaatgaaccaatgtgtcctttcctttcctttcaaacagttgtttccaggaaccagaagtgtggggctatcatatgcaagttgtgataaattaggtcttttccttcaacatttagtctcaaaaaaaagaaaaaaaggaaaagaagactccttaagggcagtatgaccatgggcaagggtgagggaacacacagctttccttagtaaatctcaagcctccaaggttggcgttggaaaggatctgcaggtagcaaatccagctgtcccactgtgcacgccctccccagttcaccttttctctgagggagactcattggtgctcaggtatgcatgtgactcttcacacacacacacacactcacactcacactcttgccaccatgacttccatttaatgttcaagaattcttctctcacagctctgtaaaatatttgagaaggacaaaaactttcaaaaaacccttaattataactgtagtatataaccatttttttaaatgaaattaaggagagtataaattggaaggctgaggtgggcagattgcttgagctcaggagtttgagatcagcctgggaaacatggcaaaacctgtcttgacaaaaaatacaaaaaattagccaggcgtggtggcgtgtgcctgtggtcccagctacttgggaagcggaggtaggaggatcagttgagcccgggaggtcaagggtgcagtgagccgtgattgtgccactgcactccagcctgggcgacagagtgagaccctgtattaaccccccacacacacacacccacacacacaagagtataaagaagaaaattacttctagggaccaccccagttccatccgtcccaaaggtctggtatgacttcggggatctctcgctggggtgtcttccttgctccctcctgacttgcttccttgctgccatataccctcttaggccctgatgggaaactcagggcacgagatttctacctgcagcatacccaaggctcattctgatccaacttactctgtgaggtttgatccttactgcaacttaatgaaagaggcacaggtaggtattactgccattttacagacaagaaacttgaggcttggggagattcaacagttgggctattgctatttgcacacaattccaagtatttagcagataactaattgcaccacacgaaggtctactacagaaatgggctgatggggtgaaactcggaaccagggcagatgctctttaactacaaagcttgtataacgcgtggtcatgttcagtattaatactagattagcttaactgaattctgagacaatggacacaagacaaattagatttgatgagaaaggagggagaggaaaggttctaaacatgggcatgctgtcagtaggatagtcctccttgtgacccacaactgacagaatggaggaaaatattttaaatcatatatcagataaagactagtatcacttatcagatatgaataaagacttcttacaattcaataataaaaagacacataatctaatttaacaatagacaaaagatgtgaatggacatttctccaaagaaaatatacaaatggccaatacgaattctcaacataattagtcttagagaaaagcaaattaaagccacagtgagatactacttcatagccactaggatatctataatcaaaaagaggataacaacaactgttggcaaagatttggagaaattaggacccttatacattgttaacaggaatctaaaagtgtatagctactttggaaaacagtttggtagttcctcaaaaagttgaacatggagttggctgggcgaggtggctcacgcctttaatcccagcactttgggaggccgaggagggtggatcacgaggtcaggagatcaagaccatcctggccagcacagtggaaccctgtctctactaaaaataaaaaaaaattagccaggcgtggtggcgagcgcctgtagtcccagctactcgggaggctgaggcaggagaatggcatgaacctgggaggcggagcttgcagtgagccgagatcacaccactgcactccaacctgggcaacagagcaagactctgtctcaaaaaaaaaaaaaaagttaaacgcagagttatcatatgaccaagaaattccattcctagatacatacctaagagagaggaaaacatgtttattcaaaaacatgcacttgaatattcatagcagcattattaataatagcccaaagtggaacaacctcagtgtccatcaaaggatgaatggataaacaaaatgtggtacatccacacaatagaatattgtccagcaataaaaaggaaagatgtacagaagccccaggagccacagccccagatgaagctggcatccctgggcccaattcctgctgccacagttccactattgccagcccccagaccttggagatcctccaccgccgacaaggctgctaccaactgccatccttgcagagggggctcctgcaaatcttttaccttgtacttgaagcaggggccagggaagaggactctggaaaggacatgtgggcctgagacaccttaaaaacaggaaaagccctgaggagcacgaaggggaaacttttttacctgtacccttttggggacttttggttaaaactgagaattacattgacatagatcaataggagaaatgcatacgaatttgtttaatataagttttgtgtggcataggagactttacaaggaaatgaagacccaaagatgcaattagagatgaacatgtatatactgatttagacaaagagaagtactttatgaaaatgtgacaaggaaaaggggcttgctagttaattggtgaagaagtggtgaagaggataaggattagtctaacaagtttgtttgtaatatttccctcagactcttcccctccttgatgatgataatatttccttctggtagagagagaacatcttttgcatgggaattttatctgctgcttttaagaaacagaaggaagggtagagtgatcttcttgcacctgctgttttttaagcgcctttaactcaaaatggtcaacatgctagagtagcatatttttaactccttcaagcagctacaacaaaatggggagaaaaaatagttacaactgtggcagtaacctacacgtgtcaaacatctctcatgaagcaaaattaacaagaataataaacaagtgacatgtcagctatggagttatcctcttactgaaagagatcccatagataataggaatttcaaaaaatctgtaatggaaactggctttaatgtaactggtaactccataaggctcttcactctgaaccactcattaacaagtgcttcagttgatgagcaagttggttcttatcctggactgcagatgccattaggtctctgctggccctatgctgatgaagacttttttaaggatgaaaatgagccccatgttaattcatgttcaactacagaaaacaacaagtgaaactttgtttgctccaaattggaaactgaaatatggaaacagcagtgtggaaggaaatttaacatatgaaggtgatttatcagaaaacgaaaaggcaaaggatactttattcaattatatttaaaggagggacctaaactgaaagccagaaacaacagaaaatgttgtagaatctttcacagaggagccaagtgaagtttttccataccctgattttctccctcctacggagcttcagtaccctggacttgcacagatgaggccctcacaaaatctgaaaattggaaagcaacaggggaaccttcagaaagctctattattggaaatggaaagattacaacatatgactatacaaaaagagaggtcaaagttacaaactactttctgtaccccagcagttactgaatgactttcttcctccaaagctatactgagagtgggacagccaaaactttctgattcactgagtcttcagacatctcgtgtagataaaagttgagaaaaaagaaaaaaaaaaccaatcgggttctttcaagcttgagcaaaatgcttcaaaatggatttggagcaatgctggaaaatataaatgaaattctagaccaccaactctaaaaagttcatccaccacaaaacagttggttgcaacttaggactttaaaactcttaaaagttcatttttaaatccgtggcaagaactttcagcaaggaccagacaacgcactgactggttaaagtggcctcaataaggtgtctgcccccaaggttttcagtaccagtctccatcttttcttgaaaatgagaagaaataaatcaaggcaccaagaaccaatcacaaactttataaaaaaaaaatagtgttgcatagaccattctatatttagaagctatttgttgccttcatttatagctaagggcttatgtattgactaaaaataattcttttctttcatatatctcagtgtgagcaaatctattccaagaagcccagctaaaatatggttcattgttcccagatacaggtattcgcccacgcacagacatacacacacacacacacacacacacacaccccaattgcttgatatgatatcgattggaatttgtgaaaattactgctgagagtattttaattttcttaattgttactttttaaaaaaatagagatgaggtctcactttattgcccaggctggtctcaatccaattcctgggctcaagctatcctcctgctttgggatctccaaatgatgggattataggcacaagcgcccagcctcgcgagagtctttatataaatccaagggcttctatgctgacatgtttgacaatctttcgcatgttatatttcaagaaatgtttcacttagtaaacggttctattcaaagattgttcttttgtgacagttttccagtataattctatcatcagtaaatggtataatgggtagggggaggaagaaagtactgaaacatactacagcatggatgagccttgcaactattatgttaagtgaaagaagctagtagcatgttgttatgttcctagttatatgcaacgtccagaatcagcaaatccatagagacagaaagtaaattagtggtagccagcggctgggagtagggaggaatggggagtgactaatgggtatggggtttcttactgggatgtcaatgtctggaattagtggtgatggttgtgtgactttgggaatatattcaaaaccactgaattatacattttgggagtaaattgtatggcatgtgaattgtatgtcaataaaataactaaattaaaaatgaaatttcaagtataaatccactaaaaattcagaatctgccatacttttgattgattcgttttgcttactcttgagggcctatcaatgtttactgactaaatgcaaagagggagaaataaaggagaggtgaaggctgggaattctggggatggagagcactttttttttttttttcttagagtcgtgctctgtcgcccaggccaaagtgcagtggcatgatctcggctcactgcaacctcagcttcccgggttcaaggattctcctgcctcagcctcccgagtagctgggattacaggtgcacgtcaccacgcccagcgaatttttttgtattttttagtagacatggggtttcaccatgttggccaggccggtgttgaactcctggcctcaagtgatccacccatctcggcctcacaaagtgctgggattataggtgtgagccagtgcacccggtcgagggcactatttatttatttatttttgagacagggtcacactctgtagcctggactagaatgcagtggctcaatctctgctcactgccgcctcgacctccagggctcaggcgatcctcctaccttagcctccagagtagctgggactacaggcgcgcgccatcgcgcccagctgatttttttttttttttttttttttttttggtgaaaacagaatttcactgtattgcccagaactcctggggtcaactgatctacctgtctcggcctcccaaagtgtgaggattataggcctgagccactgcgcctggccgacgagcacttttaaaatgcaggagtcttcctgcctctgatatctcatcccttatcaccatgcaaacaattctccttttcatagaagagtagacatttggggcggggtggtggtggtgggggattttagaaaatatctactgcatccaaatgccctactctacagacgaaaaagcaaggcccaggaggaggaaagagtttgcttactgccacccagtgagctggcaaaggcgctgagattcaaaatgagctttcctgccttcacatatcttccggctgccctttgcctattccctaaacagtcaggagccatcaagttcaggaatttgcaggtgtgcttcgctgtgaactgtggaaaagcagcgtcttctccccagaggcaagcatgtcgccttgtgaagtttgatggctcttcacttgcacactcacaaaaaagactgagcgtgtgtaacgccctgctggatgtgtgcggtgctagagagcttgggggtgaggggaggactctctcccttaagaaaatcagttgactgcagagctaacattgttttttgagtaatacctggtttttataaagtcgtcccttcagttcccaagctcctcttctgtttgttcaagccaccttcaatttgaaaaagactgaagtcacagcttctcaatccctactaatttctcatggacctactggattgctccaaatcgagtatttgggactgaactaggaagccagttcaatcctgagcccccgaggcaggcgttgggtcttctgtggagtccccagagacctgcaaccttctgaacacgcatcctcccctttccgccgaggactctgtcctgcagccgagccagggcgaatgcacggaggtcacaagggaggtgcccttggaggcgggaggtttctggccgccggggcgaccgtgctgacgaggcacctgcaggaaacagagctctgcacgctccggtccccctcacccggggagggagaggaggtacagaggcgctgggggaggacgtcgagcaggccagcctcgttgccagaacccccgccccagccggagatgggagcaccgcaccgtctcacgggggctggatttcttctccccttgcgggtgtgtgtgcgaggatggacgtggtaaatacgggttggcagaaggagcgaaccgcggtggaggaagttcttctgcttagttctcgccgcggcgaggcccgcgggccaggcgcggcgacgaaggtgcacgaaggtgccccgcgggcctggtggagttgcagcggcgcgcaggcgcactgagggccgcccgcggccggctccgcggtacaaagagcgcccccgcggggagccgggcgtcctctgggcggagggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattc

SEQ ID NO: 1299 - DNA, 1236 bp, Homo sapiens
caggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaaaaaaaaaaaaaaaaaaaaaaaaaa

SEQ ID NO: 1300 - DNA, 1234 bp, Homo sapiens
tgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaaaaaaaaaaaaaaaaaaaaaaaa

SEQ ID NO: 1301 - DNA, 1862 bp, Homo sapiens
gtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagctaaaataaaaaaaaaaaaaaaaaa

SEQ ID NO: 1302 - DNA, 459 bp, Homo sapiens
ggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaaaaaaaaaaaaaaaaaa

SEQ ID NO: 1303 - DNA, 4165 bp, Homo sapiens
ggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcagacccatctattttggatagtttagatttgaatgaagatgaacgggaagtactcattaataatattaataggcgcttgaccccacaggctgtcaaaattcgagcagatattgaagtggcttgttatggttatgaaggcattgatgctgtaaaagaagccctaagagcaggtttgaattgttctacagaaaacatgcccattaagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacatgctaagcactacatcatgctaagaagaacagttattactcagctgccatacttcagccattctacttttacaccaagaacaaaatggctagagatttttttaaaaatacaaatgccagtaccttgccgagacttgttcactgatttgccccaaccccaaggtaatggtcatctactttgcaacctatggagatcctgatagctcccatacaaagtgaggtacactgttgccaatttggaggcaggaagccatcaaactaaacgtagtttaattcagatgaacacctatcgatattcaaaaggcaaaacaaaaaaactaattccagggacattagaccttggtgaaatgccaaatggaaaatggtgctttaaaaggtagtctcttaccatataaggaataagtaaaacattagcttgtgatttctcattattcaggtcaatgttttagacacgactaacaagggacagttcaaactattaaagagaacaaatttttacttaagcactttgaggtatccactccccttaaatgtaagttatgtattttatctgttgattaaggggaggtccaagcatttgtacttggcaggaatgctggcaatagcttgtgccagattactgtataaacttgaaagtaataaaaatgttctttaaaagta

SEQ ID NO: 1304 - DNA, 2096 bp, Homo sapiens
ggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagtt

SEQ ID NO: 1305 - DNA, 668 bp, Homo sapiens
gcaaggcgggggctgagctgcgccggccggaaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaaaaaaaaaaaaaaaaaaaaaa

SEQ ID NO: 1306 - DNA, 806 bp, Homo sapiens
gggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcactgaactaatgctttaaaagccactgaatttcatttaagttgcttttcttttgtaagcccaatattcttttttttcccataaaggataattatttatatgctttagatatttttatgaaggtgaatttcagaccttttcttgtaaaattatctattagctgagaccttttaaatgcaactttttcttttaaagttatttttgagctacttttaacgtataaaattaaacattttcttggtattaataaaaaaaaaaaaaaa

SEQ ID NO: 1307 - DNA, 1648 bp, Homo sapiens
gccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactatacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggatgacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 1308 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 1309 - DNA, 1539 bp, Homo sapiens
gctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgag

SEQ ID NO: 1310 - DNA, 394 bp, Homo sapiens
  misc_feature 123, 192, 225, 302, 312, 336, 338, 342, 364, 367, 374, 377,380, 383, 384: n = A,T,C or G
tgaaattccaccatggcgtaccgtggccagggtcagaaagtgcagaaggttatggtgcagcccatcaacctcatcttcagatacttacaaaatagatcgcggattcaggtgtggctctatganaagtgaatatgcggatagaaggctgtatcattggttttgatgagtatatgaaccttgtattagatgatnccgcagagattcattctaaaacaaagtcaaganaacaactgggtcggatcatgctaaaaggagataatattactctgctacaaagtgtctccaactagaaatgatcaatnaagtgagaanttgttgagaaggatacagtttcgntnttangatgtcctttcgtccaatgtgnaanatttatncanatngtnnttgattaccc

SEQ ID NO: 1311 - DNA, 5043 bp, Homo sapiens
cgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggccacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgt

SEQ ID NO: 1312 - DNA, 1530 bp, Homo sapiens
gtgaggacaccgctttacaacgatgcagggggccccatgtcaccctcacccatgggaagtttgacttggtggactcagccaagccacagaggtctaacgcttctctgcggtgatttcaggctgccctggcagaaagcacagtgcctgcagacatgctgtcactgctccacgcatcaacgctggcagtccttggggctctgtgtgtatatggtgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgttggagggaaattataagaaactctttggcagtggaacaacacttgttgtcacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagtt

SEQ ID NO: 1313 - DNA, 367 bp, Homo sapiens
  misc_feature 327: n = A,T,C or G
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaggggttattactatgatagtagtggagtgaattgtnaggcgactgggtacagggcaccctggacaccgtctcctca

SEQ ID NO: 1314 - DNA, 2032 bp, Homo sapiens
cgcctggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaaccactccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgccgggtccttttcactgtcggtccgggacttcgaccaaaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtgcatgtgtagcctgtgcatgtatgtcttggacactgtacaaggtacccctttctggctctcccatttcctgagaccaccagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgccg

SEQ ID NO: 1315 - DNA, 1621 bp, Homo sapiens
gcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 1316 - DNA, 1771 bp, Homo sapiens
agctcccgcccgcccgcggccgcccgggagctcgtccagccccgcgctgcgctcgcccgcccgctgcccgccggagcaccgcggcctccgcccgcgtccatctgcccgccgcccgcgcctgttccgcagcccgcgtccgcgccggccccacagctctgcgtccgggtattactcagcacagaaattcaggagacacagacaagttcttccacgatgtcgtacagacgagaactagagaaataccgtgacctggatgaagataaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggaaaggtctgggttcctaagcagaagccactggatcctgtgctggaaagtgtgacgctggaaccggagctggaggaagccttggcaaatgcttcagatgcagaactctgtgacattgcagcgatcctgggcatgcacacgctcatgagtaaccagcagtactaccaggccctgagcagcagctccatcatgaacaaggaggggctcaacagcgtgattaaacccacacaatacaagcctgtgcccgacgaagaaccaaattcaacagacgtagaggaaacgctggaacggataaagaacaacgacccaaaacttgaagaagttaacctcaataatatccggaatatccccatccccaccctcaaggcatatgcagaagccctgaaagaaaactcatatgtgaagaagttcagcatcgtggggacacggagtaatgaccccgtggcgtatgcccttgctgagatgctcaaggagaacaaggtgttgaagacactgaatgtggaatccaacttcatttctggagctgggattctgcgcctggtagaagccctcccatacaacacttctctggtggaaatgaaaattgacaaccagagccagcccctgggcaacaaagtggaaatggagattgtgagcatgttggaaaaaaacgcaacacttctcaaattcggctaccactttacccagcaaggaccccggcttcgggcatccaacgcaatgatgaacaacaatgaccttgtgaggaagaggaggcttgcggacctgactgggcccatcattcccaagtgccggagtggtgtctagtgtgtggcggtggagtccatgcctttgaactggatgtgttctattgatgacctgtgctctgcaggggaaaccagaaggcaaaatgctggcagcatgaaacccttttgtggttcagttctttatgcactaaggttttaggttgactagtggttgtagttgaaaattttataaaataccgttaatgtgaagtttttctttagtcacagaagttgaatctggttattatttaaaaactagaagcccccaaaccagcagatcttactgaagatgatgttccagcagcagcgacttagccccaggagcccagtttcaatggccttgctgtgtggtgtttcaagtgcatttaaaatgtgtgacacagaaacggcacactcttccacatgcttttgaagtattataaaacactttattacaaatttgtcttagctattagcaaataaaactgattatcattctttaaaaaaaaaaaaaaaaaaaa

SEQ ID NO: 1317 - DNA, 3084 bp, Homo sapiens
aagatctaaaaacggacatctccaccgtgggtggctcctttttctttttctttttttcccacccttcaggaagtggacgtttcgttatcttctgatccttgcaccttcttttggggaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgacgccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctccccccatatctgcgtgcacttcccagagcatcttgcatccaaacctgtaacctttcggcaaggacggtaacttggctgcatttgcctgtcatgcgcaactggagccagcaaccagctatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaaccccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaagcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 1318 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 1319 - DNA, 2697 bp, Homo sapiens
gctgagcagtcaacagcatttcttgttccaagatcacccttctgagtacctctctggctgccaaattgccagggccttcacagtttgattccattctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacggtcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagactgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaggaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactaccgacatccctcccagcaccacacaccccgcccctgaaaggagatcatcagcccccacaatttgtcagagctgaagccagcccactacccacccccactacagcattgtgcttgggtctgggttctcagtaaatgtagccatttgagaaacttacttggggacaaagtctcaatccttattttaaatgaaaaaagaaaagaaaagcataataaatttaaaagaaaagg

SEQ ID NO: 1320 - DNA, 1403 bp, Homo sapiens
gaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaaaaaaaaaaaaaaaaaaaaaaaaaaaaaaaaaaaaaaaaaaaaaaaaaaaaaaaaaaaaaaaaaaaaaaaaaaa

SEQ ID NO: 1321 - DNA, 705 bp, Homo sapiens
  misc_feature 372: n = A,T,C or G
ttcccttttatcaaaacacttctatacacctggctccgggcctgcggctgagtcctataacaacgcataatgttctggaaggacttatcttcttttgtgacctttgccatcacataaatggcacacattaataactggtccagatgtctgtccatcataagttcaggacactgaattatggagaattcaaagcaggtccagatttttttcctcaattcatctgaaatatctagtttggcacagagatcccgaaggcgggacagctgctaaatggtatacctttctaaagaaaagcgataaagagctggtcttcctgggtctattactactgctggttacagactggccttgcttctgctgttggccacctgnggaaatctgttgaatggccacttgaccagggacttgcaaagttgttcctgtcacctgttgagagctcagacttccagccagggcctgagcactgaggggctggatggagcctgtcacagcttgtgcctgccccccaacattgacttggacagggaagaatgttatccctccattgtcattggcaataccttgcacaggaatggttaccgtttgcccattgttggctgtgacagtggcggttgccatggtgaccaaagtctgtccaggaactggtgtgacagaaaccagctccccagattcattctgcacagggacagcattgactaggggctg

SEQ ID NO: 1322 - DNA, 1002 bp, Homo sapiens
accttggactgaaccactattgaagatttatttgataataatttgtaagttttaactcagtacctcccttctgcttttatagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 1323 - DNA, 3004 bp, Homo sapiens
agctcgatcagaaggtaaggatcgtctgggatataatgactaggaaccatggaggtggaaagattctttgacaaacagaattgtggtgatttgtgcagaaaggagcttaagatttgatgattggattcgtcctcttaggggtggtatccttgttatggtttggctctgtgtcccgacccaaatctcaccttgaattgtaataatccctacatgtcaagggtgggaccaggtggagataacagaatcatggaagcggtccccctcccacaccaccccaccaccaaccctggtgctgttctcgtggtagtgactgagttctcacaaaatcaggtggttttataaggggcttctgccttcgttcagcactcattgtctctcctgcttccctgtgaagaggtgccttctgccatgattgtaagtttcccaaggcctccccagccatgtagagtgtcagtcaattaaacctctttataaagtacccagtttgggatatttcttcatagcagcacgagaacgaactaatacaatcctctatcactataaatagtgttatgacaatgtgtgataggagcaaaatctatcatgaatatgtagtgtctatttgagaaacttccccctccccaccacttgtgattctggtggacctgtcaactacaggagtctactcttttatcggggtaggaacccattgccctggcaacagtaattcatccaaagggtgatgatgctgagtgaaatttgaatctaatgtaaatggagttatagaaaaaatagctgaccatgagtgataccgccaccctctaagaaaccctagatataaggtgagaggaatgtagtgaagacaatcatcttataaatgaggaaaggatgacctcatgttagaggaagtgatgccagcaaaaacttaacattaaagtacctctcagagatatgtcataacattgaaagtacaaaggatgaaatgttagaagataatcaaaacttaggagtatgacaatttgcaaaggcatagaaaagctgttcatgccatattacaagttataccatgagaaggtaagtgctattcatatttttcttgataagtgtgtggtttgtttgtgtggtaagtttttttggagaaggtagaaatgttttattaaatcttagttcagagagtgcgtgggagcattatctccactattacacactatgcaacttaaaaagataatttttcaaagagaaatacatacttgccatgtacacggacaataatattgcaaaaagaaacgtccttgtttcttatgcaaattgttccataattttgaaaatttttgaatgtcactgaattgagtaaaaaacttagaaactcttgaatactagaatattcaaaagtgtgaacacaaatcatgagggagagtcaagagtgggtgaagagcggagcgtgtgagcagcacagaggcctcctctcctctcctctcctcacctcgctctcgcggcctacctttaccggcccgtctgctcggcacccagaacaccttccaccatgaccacctcagcatgttcccacttaaataaaggcatcaagcaggtgtacatatccctgcctcagggtgagaaagtccgggtcatgtatatctggatcgatggtactggaaaaggactgcactgcaagacctggaccctggacagtgagcccaagtgtgtggaagagttgcctgaggggaattttgatggctctatagtactttacagtctgaaggctccaacagtgacatgtatctcgttcctgctgctatgtttaaggaccctttccgtaaggatcctaacaagctggtattgtgtgaagttttcaagtacaatcgaaagcctgcagagaccaatttgaggcacacctgtaaacggataatcgacgtgatgagcaaccagcacccctggtttggcatggagcaggaatataccctcatggggacaaatggccacccctttggttggccttccagtggcttcccggggcctcagactccatattactgcagtgtgggagcagacagaacctatggcagggacatcgtggaggctcattacagcgcctgcttgtatgctggagtcaggattgtggggactaatgccaatcatgcctccccagtgagaatttcaaattggaccctgtgaaggaatcagcatgggagatcatctctgggtggctcgtttcatcttgcatcatgtgtgtgaagactttgaagtgatagcaacctttgatcctaagcccattcctgggaactggaatggtgcaggctgccataccaactttagcaccaaggccatgtgggaggagaatggtctgaaatacactggggaggccatcaagaaattaagcaagcgacaccagtaccacatctgtgcctgtgatcccaaaggaggcctggacaagcccgacacctaactggattccatgaaacctccaacatcaacaacttttctgctggtgtagccaatcgtagcgccagcatatgcattccctggactgtcggccaggagaagaagggttactttgaagaccatcacccctctaccaactgtgaccccttttcggtgacagaagccctcatccgcacgtgtcttctcaatgaaactggtgatgagcccttccagtacaaaaactaagtggactagacctccagctgtcgagcccctcctagttcttcatcccactccaactcttccccctctcccagttgtcccaattgtaactcgaagggtgaataccaaggtctttaaaaaaaaaaaaaaatcatggggaatttttcctataatgaaatgattgaagcgttcatacctataaaatttttcaatgttgaaaaataaaaatacttttaaagtgcaccttccaaaatgtctcccataagtaggtaagaccaacctgtatatcttaagatattagttaagaatttagagacagaggaagaaaaattcttagcagtggttattttggtaagttttctttagaaaaacactttaaatctca

SEQ ID NO: 1324 - DNA, 557 bp, Homo sapiens
  misc_feature 56, 201, 227, 240, 410, 432, 481, 519, 526, 547, 554, 555,556: n = A,T,C or G
cagcaataactatttactgagattttaaaatatttcaaggtaattggtcctaacanactgggaaaataccaaattcttttccagaactgaatcccccatcaaagttcaattttactcataattcccttttcatttgaagcatctcattgtaagccagtcttaacccttctctcacactttgcttggctgtttctcaggtanaactcagtaagtctggtagcctccangactgccgcttanattattaaacaacatgtcagtggttggaaaagtcaatgttattttgatttttctgttttgttttgttttaaatgcagttggcggataattgcagctttctttcattccctacatgagttcaaatggcagcaaacaaactaggagaacgcagaccttctgacttgtgggtncccctactcatcacctgaagancttggaaatcaaagccctgacccattaaagacggatggaaacagccacntacgatcatccctattttcttgctttgccccatccagnttaaccncctgtggtattttaattggcnaattccnnnt

SEQ ID NO: 1325 - DNA, 5021 bp, Homo sapiens
cccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctgggggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaaaaaaaaaaaaaaaaaaaaaaaaaaaaaaaaaaaaaaaaaaaaaaaaaaaaaaaaaaaaaaaaaaaaaaaaaa

SEQ ID NO: 1326 - DNA, 558 bp, Homo sapiens
tgaggcatccacagtatttaatttgtttgtatactagttacagataaacaggtacaccccatatacaattaccaatactttttatacagttcatatttcggtacatcaacactattttatttacactctatttatgtacattaacatctttctaaagtcagtgcattgtcaacaagttttatacagtaatttacaaggtgaatgtagttaatagttaatttaataaattttctgctagttcatgaattaaaaaaattaattacaaccagtataacaaacacagatcaaacaacattagtagattgagctacctgcttaaataaaacatctgtaaagaaattatttaaaatcttccactttttaatgggaatggacagattttatatactgaaaatcttgaaactataaagtatgcattctgtctgactttattacattagacaatttaggccagtcctacctacttgcaattatattttttctgaaaaggatttcaatttaggtagccatttaagataacctttccaaatgctctgagaactagatattaatagttac

SEQ ID NO: 1327 - DNA, 1080 bp, Homo sapiens
tccaaaatgaagggtctgtggaaggacatgaataaagcacaggaggttgaagtcagatttgcagctttctaggcaggagacaagacaatctgcatcttcacaggagggatggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaaagggggccggcactgccagtaaactcacctttgggactggaacaagacttcaggtcacgctcgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcccacccccaaggaggtgaaagctgctaccaccctctgtgcc

SEQ ID NO: 1328 - DNA, 577 bp, Homo sapiens
aacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatatagttaaattcactagatcttga

SEQ ID NO: 1329 - DNA, 607 bp, Homo sapiens
  misc_feature 457, 479, 541, 562, 570, 576, 583: n = A,T,C or G
ctcactgatagctgatcacattaaacaggtacaggtgctaagaaagtttaagactgatcttttggcaatgacagtttaggttaactctgtttggaattcctaaaaataaaaagaaatcccttaaaaaaggctgacaaactgaccacttggccttgaatcgactgttagggtcacacctgccaatgccaggggacatcacaaaaaaatagagaatgccaagataaaaagttcactgcattcaatttggcctaatttcttgataatagtttcctattagattttccgattaatactgatggctcttacctaggctgtgagagtttttttttttttttttttttgcaattttataactttatttgatctgacgatcagcgattagttctcatccacattgactgtctgtagatttttgaaagtgggtaacagggtacataggtaaccaaagtatatagcntatttgggtgaatcttcatccncattacgttttctggacagccgcacacgggattcgggatggcacattccctattcccttggnccagacagctttgttgagccnggggtcangcgccnacccggngtcccactcctcagggaaattccg

SEQ ID NO: 1330 - DNA, 6237 bp, Homo sapiens
ggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattctcccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcacacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcatcaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtcccttttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaatgtttcatag

SEQ ID NO: 1331 - DNA, 1863 bp, Homo sapiens
gttttttttttttttttggtaccatagagttgctctgaaaacagaagatagagggagtctcggagctcgcatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctca

SEQ ID NO: 1332 - DNA, 1633 bp, Homo sapiens
cagaatctccggcagtttttgtacctcaagaagtaagtggaacacctttccctgtcatagttattttcatccagacatctggtggaagcatcagattccttacagatataagagaggcatcatttaaaaggtagaacaggatcgacaaacaaggatttatgtcaggatctctcagcctctgtgttaccgagggcatttctaacagtcttcttactacggcctccgccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaagcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcct

SEQ ID NO: 1333 - DNA, 604 bp, Homo sapiens
  misc_feature 393, 505, 516, 521, 547: n = A,T,C or G
tgctattctccttggttgtggagctgtcactagtaaagagtcgtgaacttcttcgaggcagtgcgtttgggggagatgtaatagtggggctcaatacctgaggtgttgtacttgtttgtggaccagaactttgtgtttgtgcaagaattggagttacctctcggctatttccactctgtgagaagacagactttgttccagtttggccgattctggcaacagacttttttgaaggggctccggtggatggcacatcaattacaggaggtgtattagtgtagttttgtaaataggatccatctccaggacttggggtttctaatggcaaaatcccaaaacttggggttaatggactaagagctgctggtcctcctaataaacttcgaccagttnttggtttattttgaacctgtttagatatatgggaagttcctgttcccagtgggacagtatcaggtgaaattacagctgaatcaatataagacactttgagaatctggattcnaggagtacttntgatntggaaagaatcctaaattcaatctgnttaatccaatttgtgcctggcggtgttttcccgtaagaactggctcaagcctgtctg

SEQ ID NO: 1334 - DNA, 1880 bp, Homo sapiens
atgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaaaaaattcaaagaggccaggcgcagtggctcatgcctgtaatcccagcactttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaaaa

SEQ ID NO: 1335 - DNA, 3270 bp, Homo sapiens
atgctctggcggtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagttt

SEQ ID NO: 1336 - DNA, 579 bp, Homo sapiens
ttttttcacaaataatctcaactttaatagatattattttgtatttgtgatagtgccttcttcaagaaccttaaatgctttacagacattatctctaattaatccccacaacaaccctgtgaggtaggtattactcccattttacaagacagggagactgaagcacagagaggttaagtgacttgcccaaggtcacacagttaaattcactgaagagccaggacatgagcgctttagcctcccagctcccagccaaatacctcatgatagaatcttttaataaaaagggtttttcaaagaaggtttcaagagtggttatgttatgaaaatgaggtctttctactgccatcaaggaaagaaaaaaccctatactgatggttagaggccccaagacccacataatacaacatttccctctttccctgttcccaagcctcctggttcctgtcttaaataatcttttaaaggtaaaatttccaagacagaagccatgtgacttaagaagtgggacttaatttagaatatttacttttagttacaataatttatagaaatttttattccaatatacaaaatatg

SEQ ID NO: 1337 - DNA, 536 bp, Homo sapiens
tataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtg

SEQ ID NO: 1338 - DNA, 292 bp, Homo sapiens
  misc_feature 243, 245, 258, 264, 268, 274, 278, 282: n = A,T,C or G
cctctggattcaccttcaatcactatagcatgaactgggtccgccaggctccagggaaggggctggagtgggtctcatccattagtagtaatagtacttacatatactacgcagactcagtgaagggccgattcaccatctccagagacaacgccaagaactcactgtctctgcaaatgaacagcctgagagccgaggacacggctgtgtattactgtgcgagatattcctaccaccaggtgnanttctatgactacnggggcngggnaccctngtcnccgnccaatagtaa

SEQ ID NO: 1339 - DNA, 876 bp, Homo sapiens
cggggcggatgcggggacagcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttcctttaaaaaaaaaaa

SEQ ID NO: 1340 - DNA, 532 bp, Homo sapiens
tttcactgataacattgctttattaactgcgttggtggctcatttggagggcaaggggctccctatgacacaagccctggtggggccggggtctggaagcccccatgagtgagcaggacaggatggggctgggaactatgcagcagcggcaacacagaatcatgcagggcacagcgggcactggccacacccaggtgaccatacattctattgctcgttaagggttgcgcacatggacaatgtacaaaaaggagaaataggtctttgcgttaatgaaaaatacattttttctctacaaaggaatcttttctaatacaagaaaataaatattgcaacataagccaaaaataatttaaaattgctcttttcaatatattttcaatatttctcttgtatattaacaaatggcacatcactttctttgaaacaaagacagaaggtgtctcctcctgtgacattcatatcatccccccaccgtcccctcaaactgacgtggaacacaaagtgtttgtgcctctgagggagaaagtgg

SEQ ID NO: 1341 - DNA, 833 bp, Homo sapiens
gggctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccattcaaaatcaagaagaaaggctgaacccggagagaaaagggagcaactgatgttgccatgcagatcccttggttgctatgagatggtaacatcactctgacccaacattggccagtgcctcctcagctgcggtgcctcccaggctgtgtggttctcacgcgggccactgacacagagctgttactatggtgaactttacaatttcctttgcattgcgtggatttcagaaatcaggccatcagcggaattcattcatattcagctaaatgctcttccagaaagacaagcaggagtactcctggctggaggcggcatgcctgaggtcagagtcaaagtagggtaagtgctcgtctgaatcctttatcccagtctccccaggctggatcagcttctcaggttctcaggtggatttggctcctcgagccaaagccaagccatcgcatccactgtgaacttggcccgaatattatgccaagaaggcctgaaagtacctgaaggaatcacaaaaagaagctgcattatgcttggcccaccttgaatggatgacattcaaccaaaaagaaggtgttaatgggcgggccttgccttaatgatgacattactgtggaa

SEQ ID NO: 1342 - DNA, 579 bp, Homo sapiens
  misc_feature 63: n = A,T,C or G
ggaatctgaactcggatgatcaggctgttgtgctgaaggcctgagattggcgcccgaggtcantgcgaagggacgggctgcgggcctcagctccctgctcgtccatggcaacaacaaggtcatggctgctgtcagacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaa

SEQ ID NO: 1343 - DNA, 1650 bp, Homo sapiens
agtctgagcccagagagccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaacttggcttcaagaacacaaccttaggaccttgggccccaaaagctggtggtgaaatgaggaggagccaatttaagaagacccttatggagacctgaggctgcagaaactggtaggtttcatcaggtggttaaagtcgtcaaagttgtaagtgactaaccaagattatttcattttaaaaccatagaataaaaatgacacctgagcttctctatgaatgaaaa

SEQ ID NO: 1344 - DNA, 560 bp, Homo sapiens
  misc_feature 508, 523: n = A,T,C or G
tcttgctcctcccgtaccaactgccgctgctctcgtttcctcttaattaatgatactctgtctttgatagctttagccatggtcttgtgatcaccttcacagacatacccagactctaccatttcttgtgcaacatcttctgggacatctctctctaaatcaaaagaaaactcaatagcttcattatctttgtattttccctttaatttcttaatatcttcaatacgtagccataattttatggctattttttctccatcatcctcttctgctaattctacccgtactcctgtttcctcttggaagaaggcatggttcaaaaggtctttgatggaatatctttcatctttgttttgtcgtatgcatccttcaataatttccttcacttcaggaattgctactttgtcaaaactggctggcttcaccccctcatttatacaatccttttgagggcagcagcagcaatgagaatttatgatgacaaatactgagcaaaaatctttctttntaatatccatcaganaaggcaaaacagatttcttattggaggaaaatgaagg

SEQ ID NO: 1345 - DNA, 510 bp, Homo sapiens
ccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctga

SEQ ID NO: 1346 - DNA, 2564 bp, Homo sapiens
tcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccccgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacgggcggggtcaggctgatgcttcacgagcagaggtcataccccttcatcagagatgagggcatctacgccatgtcggggacagagacgtccatcggggtactcgtggataagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgtccaccccgggtgggtgaaactcactgagcagccaagactgttgcccgaggactcactgtatggtgccctctccaaagggtcgggagggtagctctccaggccagagcttgtgtccttcaacagagaggccagcggcaactggtccgttactggccaagggctctgaagaatcaacggtgctggtacaggatacaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactgagaaaaaaaaaaaaaaaaaaa

SEQ ID NO: 1347 - DNA, 2595 bp, Homo sapiens
tcatattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgttttacctacagagcaattcaactcatgcttatttatagtactaacttttaatatgatctttaactaaatcctatatttgaaatcatacacaaggactcaagagagatattgtgtaactaggatgcattttccaatgagatatcttgcagtttctgttctgggtagatttttttctctcatatgcaccacccttactgtatattcagtcctatactcttattcagggatttaactatggtcgtagcatagggctgaagtgttgtgaatatgatgaaaatgtgatgagaccaaacaaaccatggggcacagtagagcatcactcctgccaagtggtctttgtatggcatgctggctgcaaataaaggagatctgggac

SEQ ID NO: 1348 - DNA, 1384 bp, Homo sapiens
gtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 1349 - DNA, 1345 bp, Homo sapiens
tatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccaatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaatacc

SEQ ID NO: 1350 - DNA, 3378 bp, Homo sapiens
acagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaaaaaaaaaaaaaaaaa

SEQ ID NO: 1351 - DNA, 1473 bp, Homo sapiens
cgctctccgcaccgcgcttaaatgatgtattttgtgatcgcagagatgaaagctcaaattgagattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcatcgatggatttatggaactgtgtcaaaatgatcaaattgtgcttctaaaagcaggttctctagaggtggtgtttatcagagtgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatgctaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatg

SEQ ID NO: 1352 - DNA, 600 bp, Homo sapiens
tttttaaataataaatgaaagattttattcatctttgtagataacaagcactcaaaggttaatgagtgaaggagataaccatctcctccaaacaaagaggctcttaataacgcagaagcaaaaatctttccacttttagatgaaaacaaactaaaaaataacttcaggcttcagatatggaaataaagcaccatttttcaaatggtagacttggcttacttaaaataagtaaatagccccagactatctgaaaaagaaaaacatttcaatgccccttgtgagttctaattacatggctacatgttaaggaacatctcagatctctctctgaacctactagtaaacaaaaattatacagatatatatacaaatgtagtcttccatttcattttttcatttgcacaagcttccagctatttaaccaggtgacaaatcaaagtgacaagatgcactaatattcgtgagaactttaaattttaaaagctagtatttaattacccttagtgagctcatttacttacattaaaaattatgcgatcagtcatgatttttctttagaccatttaataatacacatggactaacatttatcatgctttg

SEQ ID NO: 1353 - DNA, 2100 bp, Homo sapiens
cgatgatgaggctgaagaaaaggaagacaaagaagaagaaaaagaaaaagaagagaaagagtcggaagacaaacctgaaattgaagatgttggttctgatgaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcggcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcgttcataaactttcctatttatgtatggagcagcaagactgaaactgttgaggagcccatggaggaagaagaagcagccaaagaagagaaagaagaatctgatgatgaagctgcagtagaggaaaaaaaaaaaa

SEQ ID NO: 1354 - DNA, 464 bp, Homo sapiens
ctccccagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattcaaa

SEQ ID NO: 1355 - DNA, 2740 bp, Homo sapiens
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaaacggcaacggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctactacgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaa

SEQ ID NO: 1356 - DNA, 3701 bp, Homo sapiens
gcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaaaaaaaaaaaaaaaaaaaa

SEQ ID NO: 1357 - DNA, 901 bp, Homo sapiens
ggagcagccggccacggaagcagcaggagagaaccccctggagttcctgcgggaccagccccagttccagaacatgcggcaggtgattcagcagaaccctgcgctgtgcccgccctgctccagcagctgggccaggagaaccctcagcttttacagcaaatcagccggcaccaggagcagttcatccagatgctgaacgagccccctggggagctggcggacatctcagatgtggagggggaaggtgggcgccaatagggagaggaggccccgcaggatgaactacatccaggtgacgccgcagggagaaaagaagctatagagagggttgaaggccctgggcttcccagagagcctggtcatccaggctatttcgcgtgtgaacacaaaatgagaacttggctgcaagttcctcctgagtcagaactttgattgacgagtgatgccaggaagccaggccaccgaaagccccaccctacccttatccatgaaaagttttataccaacgaaacaacatatatatatatcatgttattaagaaaattgcgcaagcaaacacatcaaagcatctttacacaaccacgccaacagtcaagctttcctgggtcctcccttaagagtggcccttggtccccaatcttcccgcgccgagaaaggttgtccccccggtcttcctccccaagccaaggcttgctctagaggtagctggcaggcctggaagcgaaggattgggcgctcctcggccttctggccagctcttggcgcagacggaaagggggtggtgcctccctccccgaagacctgggaccgcccatcctttaggaaggggctggcccttggtcccatggtgccaattcattagggtgagcagcccccgtggtggctgggggatttgtgcccc

SEQ ID NO: 1358 - DNA, 599 bp, Homo sapiens
  misc_feature 375, 512, 568, 589: n = A,T,C or G
gattgacatagtgctttatttaagctgtctgtacgaaggaaaatcatgttcatccctatcatatacgtgtaaaaatactaaggatgtacagtgtacaaaaacagtttctcctagttattccacatccttgtgggtcatatacttcaggaaatagacaggtttagtatgaccaacagtaatagtaatacagtttcttgggtttatagttgcatctgcttaaaatccttaaccagatgactagatcttgcgcagatctaatgaaagaactagcaaggtcaagaaatgtcacaaactataaagctacagggaggtaattcaattaccaatttagaggttttctttttatttaaataaatactttacatttcatgcttngcctgtaatgcactaccaggagcaagataaggaaattctactggtagacagtacaaacagtagcagcaaagtgtgtatgttgaggtgtaatagagagaccctgcagttagtaaggaaggcccttacttttgtactcnaggagaagccagtgggcccctgcaagaacagtcagcttttaagaagccgggaatcnggggtggggaaatgggaaacnatccttgaat

SEQ ID NO: 1359 - DNA, 491 bp, Homo sapiens
acctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgg

SEQ ID NO: 1360 - DNA, 2214 bp, Homo sapiens
cctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaaaaaaaaaaaaaaaaaaaaaaaa

SEQ ID NO: 1361 - DNA, 1090 bp, Homo sapiens
gttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccacgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctgaaaaaaaaaaaaaaaaaaaaaaaaaaaaaa

SEQ ID NO: 1362 - DNA, 893 bp, Homo sapiens
attgttagttttggggtaatggaaacccactttttcattgtagtgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgaaaaaaaaaaaaagaaaaagaaaaaaaaaaaaagaagaacagaaaacaagagacaacaacagaaaaagaacaaacagacgacaacacagcacgcacagcgccaccaccgtacgacaaggagaaaaacaaaaaccgaccaaaaaaggacagagggacgcagggacaacaaaaaaccaacgaggaagacagagaagaaaagaaaaggagagaggaggagaagagaagaaagagagggggggaagagggacaaagaggaagacaacagatcagagagaaagagaagagaaacgaggagaggaaaaagacaacgcaaatatgttaagtaactacaactcgagtgatcagcactgagggggagagcgggagagaaataagggagaagggtgc

SEQ ID NO: 1363 - DNA, 2368 bp, Homo sapiens
cgggcgatgccgcgctgcgggggggccgcacagccgccgccaccgccaccgccgccgggtggggtgggaggggcgggaacgcgcgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaagtattaagtttcacaagctgtttgtactcaaatatattttctcagtttcag

SEQ ID NO: 1364 - DNA, 824 bp, Homo sapiens
gaattcgaatgccaccctcccagatgggggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctggccaggacgctgtcatcgtgctgctgggcacccgcaatgacctcagtcccacgacagttatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctggacatgaggagcaaaggaagggggcaataaatgttgagccaagagcttcaaattactctag

SEQ ID NO: 1365 - DNA, 570 bp, Homo sapiens
  misc_feature 342: n = A,T,C or G
ttttttttttatatatatatgttttttaatttaaaggggaagtacactgcacaccttcctccactgggagaaagagggcccaatccccagctacccaccccccaccccccaaacacacacacacacacacgtacacactgactaaggcacagcgagggtgggcaggcatgctttggcaatggggccccttggggctgatggcatggacggctgcaaggggtgtggatgtgagctcagcacctttggaggtgggtggaggcaaggagagaaagaagtctcagggctcccaaggacacaggagaaggtgcttgcaaaacaggcagataagaaagccgacagaancccagaaaagagatgagaaaaaagaagagtggaaaaagagaaacaggctgggtgcggcactcacacctgtcctcccagctacttgggaggctggggcaggagaatcgcttgaacccaggaggcgggggttgcagtgagtcgagatcgcaccactgcgctccagcctgggccacagagtgagaatccgtcttaaaaaaaaaaaaaaaaagaaagaaaagaaaaagagaa

SEQ ID NO: 1366 - DNA, 2279 bp, Homo sapiens
gaattcggggtggcgagaggggcggggtggccggggctgtctccacttggccccgctcccggcccgccccgccgccgccccccggatgagggtatatattcggagtgagcgcgggaccgatgagtggccgcgccgaaggagctggagacggtcgtagctgcggtcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatagctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggaaaaaaaaaaaaaaaaaaaaaaaaaaaaaaaaaaaaaaaaaaaaaaacccgaattc

SEQ ID NO: 1367 - DNA, 821 bp, Homo sapiens
  misc_feature 487, 578, 583, 598, 610, 634, 641, 697, 735, 753, 778, 816: n = A,T,C or G
tgtatggggtctaaattatcccttgtaatatatatgtgtgtattcattccacagagaattagatgatccgcctccaggtaacctgctgggaatttcttgagattttggctccccttgaatggccgcatccaacttgttttgttagaactcccagcatcacagcgatggcagctctcttagattccccatacatccacgacctatatcatgtccaataaatcgtccacatcaccaccttcttcaaatacagctgctgtgtctccacttggtttgtctttgggggccagaaactttttggcttcctcagctgtgacagaacttccagaggcttcctctttggtgatcagagtaattccatcctggacaacaatttcccagaaatgatttaattgtttaatttccactttctcttgaagggctttcaggaagttgttaaaggggcggctcttctgaaaactaatggctcttcccggaaggcttcggatgnagtcatgctcttcataaaatacggtgtttcattagtattccaaaacgttcgatgtgattatgaggcggttactcgcttcctcaagcgggcntctcngtttcacagaacacngaagtttcagcngatcacacttccaaagagtgacanggccttnggccagacgggagacgcgaatggggctccccctggctcagtctttaatttttaggncgtaggtccatcttcatggttggtctgggaaaattccngaggagtccactgaatcntttctggctcaatccgagggaaaangggcttatttagagagaggattcgacttttggtggtancccag

SEQ ID NO: 1368 - DNA, 1536 bp, Homo sapiens
acagagcttcaaaaaaagagcgggacagggacaagcgtatctaagaggctgaacatgaatccacagatcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaagaatttgcatactgctgggaaaactttgtgtacaatgaaggtcagcaattcatgccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacact

SEQ ID NO: 1369 - DNA, 1626 bp, Homo sapiens
acttccgctttggaggcgaggacccgagcgagtgtagggggtgcggcgtctggtcagccaggggtgaattctcaggactggtcggcagtcaagccatcatgcctcgtggtcagaagagtaagctccgtgcccgtgagaaacgccgcaaggcccgagatgagacccggggtctcaatgttcctcaggtcactgaagcagaggaagaagaggccccctgctgttcctcttctgtttctgggggtgctgcttcaagctctcctgctgctggcattccccagaagcctcagagagccccaaccactgccgctgctgcggctgcgggtgtttcatccacaaaatctaaaaaaggtgccaagagccaccaaggtgagaaaaatgcaagttcctcccaggcctcaacatctactaagagcccaagcgaagatcctctaaccaggaagtcagggtcgttggtgcagttcctgttgtacaagtataaaataaaaaagtccgttacaaagggagaaatgctgaaaattgttggcaaaaggttcagggagcacttccctgagatcctcaagaaagcctctgagggcctcagtgttgtctttggccttgagctgaataaagtcaaccccaacggccacacttacaccttcatcgacaaggtagacctcactgatgaggaatccctgctcagttcctgggactttcccaggagaaagcttctgatgcctctcctgggtgtgatcttcttaaatggcaactcagctactgaggaagagatctgggaattcctgaatatgttgggagtctatgatggagaggagcactcagtctttggggaaccctggaagctcatcaccaaagatctggtgcaggaaaaatatctggagtacaagcaggtgcccagcagtgatcccccacgctttcaattcctgtggggtccgagagcctatgctgaaaccagcaagatgaaagtcctggagtttttggccaaggtaaatggtaccaccccctgtgccttcccaacccattacgaagaagctttgaaagatgaagagaaagccggagtctgagccagagttgtagccaggccttgcactactgccatagccaatcaatctcccaaagccaagtttacctgctgttctcacccccaatgaggtcttaggcagattctttactttgtaattcaaaaggcctgttaacctttgttcttgttatgcatgaataacttgttgactttttttttttctctttttcaactagtgtttcaacaggtttatttagattcagaatgtaaatttacaaatgatatagatcaccctgttattgctgtttttcagggacagtagaaagtgttttgttttttgagtgaaacaacttattaataaaaatccttaaatcacttttgtaatccaggacaagaaaatgtggcattagagtagaaatatctttggaaatgtgaaagaccccatagtgaaatatttgggatcagaagccagaggggtaaaagtggtcaattcttggtttacttcatttaatctttcttttcataaagatacatacctggatttgtttatgttattcaagaatgtgtgagaaattaaaccatagttagttaaaaaaaaaaaaaaaaaaaaa

SEQ ID NO: 1370 - DNA, 3871 bp, Homo sapiens
aggatctacagcctcaggacccccgtcccaatccttaccccttgccccatcaccatcttcatgcttacctccacccccatccgatccccatccaggcagaatccagttccacccctgcccggaacccagggtagtaccgttgccaggatgtgacgccactgacttgcgcattggaggtcagaagaccgcgagattctcgccctgagcaacgagcgacggcctgacgtcggcggagggaagccggcccaggctcggtgaggaggcaaggtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtcccccaacacccaaccccacccccatcccccattcccatccccacccccacccctatcctggcagaatccgggctttgcccctggtatcaagtcacggaagctccgggaatggcggccaggcacgtgagtcctgaggttcacatctacggctaagggagggaaggggttcggtatcgcgagtatggccgttgggaggcagcgaaagggcccaggcctcctggaagacagtggagtcctgaggggacccagcatgccaggacagggggcccactgtacccctgtctcaaaccgaggcaccttttcattcggctacgggaatcctagggatgcagacccacttcagcagggggttggggcccagccctgcgaggagtcatggggaggaagaagagggaggactgaggggaccttggagtccagatcagtggcaaccttgggctgggggatgctgggcacagtggccaaatgtgctctgtgctcattgcgccttcagggtgaccagagagttgagggctgtggtctgaagagtgggacttcaggtcagcagagggaggaatcccaggatctgcagggcccaaggtgtacccccaaggggcccctatgtggtggacagatgcagtggtcctaggatctgccaagcatccaggtgaagagactgagggaggattgagggtacccctgggacagaatgcggactgggggccccataaaaatctgccctgctcctgctgttacctcagagagcctgggcagggctgtcagctgaggtccctccattatcctaggatcactgatgtcagggaaggggaagccttggtctgagggggctgcactcagggcagtagagggaggctctcagaccctactaggagtggaggtgaggaccaagcagtctcctcacccagggtacatggacttcaataaatttggacatctctcgttgtcctttccgggaggacctgggaatgtatggccagatgtgggtcccctcatgtttttctgtaccatatcaggtatgtgagttcttgacatgagagattctcaggccagcagaagggagggattaggccctataaggagaaaggtgagggccctgagtgagcacagaggggatcctccaccccagtagagtggggacctcacagagtctggccaaccctcctgacagttctgggaatccgtggctgcgtttgctgtctgcacattgggggcccgtggattcctctcccaggaatcaggagctccaggaacaaggcagtgaggacttggtctgaggcagtgtcctcaggtcacagagtagagggggctcagatagtgccaacggtgaaggtttgccttggattcaaaccaagggccccacctgccccagaacacatggactccagagcgcctggcctcaccctcaatactttcagtcctgcagcctcagcatgcgctggccggatgtaccctgaggtgccctctcacttcctccttcaggttctgaggggacaggctgacctggaggaccagaggcccccggaggagcactgaaggagaagatctgtaagtaagcctttgttagagcctccaaggttccattcagtactcagctgaggtctctcacatgctccctctctccccaggccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggaaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttcactggctcgtttcttttccgttcactcagcatctgctctgtgggaggccctgggttagtagtggggatgctaaggtaagccagactcacgccta

SEQ ID NO: 1371 - DNA, 3563 bp, Homo sapiens
atcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaagtgctctttattaaataacaaatttcttcagtggtctagagccatatctgaaatattgctaagcaatttcagttcatccaggcacaatgtgattttaaaaatacttccatctccaatatttagatatagattgttttgtgatgtatgaggaatgtatgttagtcttccagatctttgaatgcctctaacacagctttgccttctaaagcggtaattagggatttaaaaaacaacctttagccctttatcagcatgaaatgcttgagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgaaaaaaaaaaaaa

SEQ ID NO: 1372 - DNA, 626 bp, Homo sapiens
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaaaaaaaaaaaaaa

SEQ ID NO: 1373 - DNA, 1244 bp, Homo sapiens
agagatggggacggaggccacagagcaggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctcgccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaatgaaaaaaaaaaaaaaaa

SEQ ID NO: 1374 - DNA, 3059 bp, Homo sapiens
gttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagaccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaaaaaaaaaaaaaaaaaaaa

SEQ ID NO: 1375 - DNA, 2540 bp, Homo sapiens
acgagacgaagacggaaccggagccggttgcgggcagtggacgcggttctgccgagagccgaagatggcagtgaacgtatactcaacgtcagtgaccagtgataacctaagtcgacatgacatgctggcctggatcaatgagtctctgcagttgaatctgacaaagatcgaacagttgtgctcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaaataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcagctccccagaggcccatctcaacacagagaaccgctgcggctcctaaggctggccctggtgtggtgcgaaagaaccctggtgtgggcaacggagacgacgaggcagctgagttgatgcagcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgtatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggtttcattgagcatttctctatttttccagttatcccgaaatttctatgtattattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactgggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaaaaa

SEQ ID NO: 1376 - DNA, 1430 bp, Homo sapiens
ctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacccaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaa

SEQ ID NO: 1377 - DNA, 1658 bp, Homo sapiens
gggatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaaaaaaaaaaaaaaaa

SEQ ID NO: 1378 - DNA, 220 bp, Homo sapiens
gaatcagagatcattgatttcttcctgggggcctctctcaaggatgaggttttgaagattatgccagtgcagaagcagacccgtgccggccagcgcaccaggttcaaggtacccggctgtcctgggagggggctgcgctgggcttgccgggactctctcggctctgcatagttgcacttggcttcacccgtgtgactttcgtaacggggagagagagaaa

SEQ ID NO: 1379 - DNA, 3783 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttcgaatctaccatggttcccatgggctggagcatattgctaggagggtacataatgccactttgattttgtcagaaggtctcaagcgagcagggcatcaactccagcatgacctgttctttgataccttgaagattcattgtggctgctcagtgaaggaggtcttgggcagggcggctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcatgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggttttttttttttttaatctgcatttattagtattctaataaaagcattttgatcggaaaaaaaaaaaaaaaaaaaaa

SEQ ID NO: 1380 - DNA, 492 bp, Homo sapiens
ctgttttgttttttttttgacgtttttgtttttttttgagacagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcacaaatcacagagggacttagtattccattaatacaaatggaaacattaagttcatcatcagatgataaaaggaaaaaaaaaacacctgatactcatctcaaaagacgcagataagacatttgcataaatccagcacctattattacttcaaatttaaaaacttcttcttttttaagagatagggtatcactatgttgcccaggctgatcttgaactcttggcctcagatgatcctcctgcctcagcctcccacagtgct

SEQ ID NO: 1381 - DNA, 1732 bp, Homo sapiens
agagaaaaaaggtgacagaaagagaaagatagaactggtggttggggttctgggcagcccatgcttcagcccctgcaagctgatggtaccgagcatgagactgtgaggtacgggccccatcacatggtgctaacataatctgcgaaggcctgggatgagtcccatgagtcgctaaccacatggcaggtagcccggagccgccggatggcttccctggctgtgactgcatcctggtccagccagttttggaagaggcgcaggtgaccaaaggctccacggccccagcgctccagccgcttggcgaactccagaagcccatctggcttgatgcagttggaactgatgtccagctgacagagagaggaggatgaatcctctgagaaaacatctgccaaggccagcaggccagcattccccaggcggttccctggcagccggaggcccttcagtgtggagttgcccttcatagcagcaaccatctcaggcagaaattgggctgggcgcttctcaaacagacggcagaaggagaaggtaatctcttgcagagtcagattctgtagcaaaaagagcacctcgctctgacagtcagcgagattcatgtcatggaagctcagtcttttcagggctaggttgtactctttgagtgtttgcaaaacaagcccaaaatcctggggagaggcaaaggtggcactatccagggacagctgctgcagagaacccgaggccttcagaacggagcacagcagtggggctggctgggctccccgtggaaatcccatctccaactgctccaggcagttttctggtatctcctcatcgcctattatgtggctagggggccctgcattccctggcacaccagggttgtcccgctggcttgggtggtcaacacgaatagagaggacccgtagcaggggcagtgctcgcacgatagcacgtgtcggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggaaaaaaaaaaaaaaaaaaaa

SEQ ID NO: 1382 - DNA, 661 bp, Homo sapiens
gggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaactttgtgggtgtgggaggatggagagagaactctaacacaaaacatttattaaaattgtacttgagagacaaaaaaaaaaactctgttgttttt

SEQ ID NO: 1383 - DNA, 4923 bp, Homo sapiens
cggcggcggcgcccgcgggctgggagccggggcccgcaggtggaagcgcacccgggaggcgggccggccggggctggagcggctcgggcgggctcttgacgctcagccagcttcgctccggcctcgggaaggcgcgcgtcccgccctgacccgccggcctctcccaccccagcagtgacgcgccgcctgggagctggagcccgcgcagcgccccgcagggcgatggacggccgaaccccgcgcccgcaggacgccccagccaggagaaaaccaaaagccaaggcaccacttcctccagctgagaccaaatatactgatgtctcttcagctgctgattctgtagaatccactgctttcatcatggaacagaaagaaaacatgatagataaagacgttgaactctcagtggtcctacctggggatattatcaaatctactactgttcatggcagtaaacctatgatggacttgttgatattcctttgtgcacagtatcacttaaatccatcaagttacacaatcgatctgttgtcagctgaacagaaccacattaaatttaagccaaacacaccaataggaatgttggaggtagagaaggtaattttaaagccaaaaatgttggataagaaaaaacctacacctataataccagagaaaactgtgagagtagtgattaattttaagaaaacacagaagaccatagtgagagtgagtccacatgcatcgcttcaagagcttgcccctattatatgtagcaaatgtgagtttgatccgttgcatacactattgttgaaagattatcaatcgcaggagcctcttgacttgacaaaatctcttaatgacctgggactaagagaattatatgcgatggatgtcaacagagagtcctgccaaatatcacaaaacctagatattatgaaggagaaagaaaataaagggtttttcagtttttttcaacgcagtaagaaaaagcgagaccaaactgcaagtgcccctgcaacccctctagtaaataagcaccgcccaacttttacaaggtccaataccatttccaaaccatatatttccaacaccctgccgtcggatgcacccaagaagaggcgggctccactgcccccgatgccagcatctcagagtgtcccccaagaccttgcacacatccaggagaggcctgcttcttgtatagtgaaatccatgagcgtggatgagacagataagagtccctgtgaagcaggaagagtgagggcaggttcactgcagctcagcagcatgtctgcagggaattcatctttgagaaggacaaagcgaaaagcaccttccccaccctccaaaatacccccgcatcaaagtgatgaaaatagtcgtgtgactgccttacagccagtagatggagttcctccagacagtgcttcagaagcaaactctcctgaggagctatccagcccagaaacctttcaccctgggctttccagtcaggagcagtgcactgcgcccaaactgatggaggaaacctctgtctttgagtgccctgggacacctgaggcagccataacatcattgacatctggaataagctctgattatagccttgaagagatagatgaaaaggaagaactgagtgaagtgcctaaagttgaagctgaaaatatttctccgaagtcacaagatattccttttgtatctactgatataataaatacactgaaaaatgatcctgactcagcccttggcaatggtagtggagagttctcacaaaactccatggaagaaaaacaagaaactaaaagcacagatggacaagaaccacacagtgtagtatatgatacaagcaatggaaagaaggtagttgacagtataagaaacttgaagtcgttgggcccaaaccaagagaatgttcaaaatgaaataattgtctatccagagaacacagaagacaatatgaaaaatggagtgaagaaaacagaaatcaatgtagaaggtgttgccaaaaataacaacattgatatggaagttgagagaccatcaaactctgaggcacatgaaactgatactgctataagttacaaggaaaaccatctagcagcttcatcagtaccagatcaaaaactgaatcaacccagtgcagaaaagacaaaagatgcagcaattcagacaaccccttcttgtaacagttttgatgggaaacaccaagatcataatttatctgactccaaagttgaagaatgtgtgcaaacttcaaataacaacatatcaactcaacactcatgcttaagttcacaagattctgtaaatacctcaagggaattcaggagtcaaggcaccctaattatacattcagaagatccgcttaccgtaaaagatccaatttgtgcacatggtaatgatgatcttttgcctcctgtagataggattgacaaaaattccactgcttcttacctaaagaattacccactttatagacaggactacaatcccaagccaaaaccttcaaatgaaattacacgagagtatatacccaaaattggcatgactacttataaaatagtgcctcccaaatccttggaaatatcgaaagactggcaatcagaaaccatagagtataaagatgatcaggacatgcatgctttagggaaaaagcacactcatgagaatgtgaaagaaactgccatccaaacagaagattctgctatttctgaaagcccagaagagccactgccaaaccttaaaccgaagcctaacctgagaacagagcatcaagtgcccagttctgtgagctcacctgatgatgccatggttagtcctctgaaacctgctcccaaaatgacaagagacactggcacagctccttttgcaccaaatttggaagaaataaacaatattttggaatcaaaatttaaatctcgggcttcaaatgcccaggccaaacccagctctttttttttgcagatgcagaagagagtatcgggtcactatgtgacatctgcagctgccaagagtgtccatgctgcccctaatcctgctccaaaagaactgacaaataaagaggcagaaagggatatgctgccttctccggagcagactctttctcccttaagtaaaatgcctcactctgttccacaaccccttgttgaaaaaactgatgatgatgtcatcggtcaggctcctgctgaagcctcccctcctcccatagctccaaaacctgtgacaattcctgctagtcaggtatccacacaaaatctgaagactttgaaaacttttggtgccccacgaccatactcaagttctggtccttcaccgtttgctcttgctgtagtgaaaaggtcacagtctttcagtaaagagcgcaccgagtcacctagtgccagtgcattggtccaacctccagccaacacagaggaagggaagactcattctgtaaataaatttgtggacatcccacagcttggtgtgtctgataaggaaaataactctgcacataatgaacagaattcccaaataccaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccactgcacttcacttccacttcagaccaacttcatactaatggaacattttggcaaatgtatattcagatgtacactaatatattatctattaaaatattagaatttgtgttgtggcttttaatgccagaagaaaagttaccagaatttataatttatagtaattttttgatcttttttttgccttaagagttgaatatgctgctttagaactttaaaacaaggtgtaaatgattttcattttttacaaatgaaaaataattcctttgtattgatttcacttaccagcacattctctacaatggtgacttagacaaaagtataagattcatagactttatatttgtatgacatacaactaggacaaacatagatatgacatttgctgcctcagtgtagcaattggaaatatttataagttatatgaaagcctgttttgggctgaaagaatgatttagaaaactagtgataccaaataagtatattcagttcaataattattttcaatgatgaatcacttagtgtgaaagacttgccttgtgtattctttatgtaattacaaatcactgtcaattttatgggaagctcatagtattttaatattttattaacatggaactcttgtttttttaatctttagaacttaaattctacaagaattttaaatattttctgtatataattatgacattgtcacacagaaattacacattttatgtgccagaagccttaaacatctttctgtgaaaatgctgatatattgtgacagttatttcacatttgatatgtagagaggaataggggttagtttatgtttatattgaaaaactttaaagactatttggaagttccagaaattctggttttaattcaagtaaaatgataaaatagtcattatatagttcagatgctaatattctaagtaataatatatatttacattgaagctaaaactgttaagcaaaacaatgcccatttgtcggcttacagctcttccggagtctagagcctgttggtgttctgtccctactttaagaatttaattgctcacttattctgaaagctttgttcaaacaagatgatattaaatttgttttcactaaaactactgggatatctgcctcttggggatttttttttcaatttaataaaagcaagttgtatatttggggtgctttttaaaa

SEQ ID NO: 1384 - DNA, 2290 bp, Homo sapiens
agaacatagggtactccgagtgaagaattcagcagctaagtggaagttgtcttctattccactttaaatacttttatctactgaatcgcaagaaaattgggtttctggtgctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgccaaaaaaaaaaaaaaaa

SEQ ID NO: 1385 - DNA, 2438 bp, Homo sapiens
agaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttc

SEQ ID NO: 1386 - DNA, 707 bp, Homo sapiens
  misc_feature 272, 346, 382, 406, 421, 430, 493, 510, 523, 536, 546, 564,609, 632: n = A,T,C or G
tcctagtgccaggtttattccctcacatgggtggttcacatacacagcacagaggcacgggcaccatgggagagggcagcactcctgccttctgaggggatcttggcctcacggtgtaagaagggagaggatggtttctcttctgccctcactagggcctagggaacccagaagcaaatcccaccacaccttccatctctcagccaaggaaaagccaccttggtgacatttagttccaaccattatagtaagtggagaagggattggcctgntcccaaccattacagggtgaaaatataaacagtaaaggaagatacagtttggatgaggccacaggaaggagcanataacaccatcagaagcatatgcagggaaagggcanttactgggcttctgggctgcttantccctgacttgacangaagggtanggaaaatggatggggctcattgtttgacattaataatatccacgaattcagacttaagggaancaccacccacaaagaanccatccacatcangctagctagccanctccttacangttaccccaatcacaaancctgcataaataatacagatactctaagccaccagatcaaaaacnttgaacttcagccatcctcaaancttctcgtgtactttcttaacctaatgagatatacagtcttacccatacccataaccccacaaactcataaagcc

SEQ ID NO: 1387 - DNA, 6480 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgttttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattttgaagttttggagagggaagtggagcagccagcaagtaagctagccagagttttctcaagagccagctttgctcagcacactctcctgggccccaaggagtcccacggaatggggaaagtgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggactttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 1388 - DNA, 1468 bp, Homo sapiens
cacattctccccagaggccgagatgcgggtcatggcgccccgagccctcctcctgctgctctcgggaggcctggccctgaccgagacctgggcctgctcccactccacgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggtgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaaaaaaaaaaaaaaaaaaa

SEQ ID NO: 1389 - DNA, 593 bp, Homo sapiens
  misc_feature 593: n = A,T,C or G
tttttttgaagacatatttcagttttattatcttttaggcatagacgggtatgttaatccatttccacaaacaattcctataatcacatatagggagtgaaccttgaacttgcaaaacctgtttcctgttgccaaagagttaaattggagagccgaaacctcaaaagttgaggatttggaattctttttcttcttagcatcttcgtgcatgtggctgccattaaacaagtaagctttcctctttatccaggcactgaatcgatggtaataatgttgtctttttttttcctggcaaactttctgctttcggtccagagctctgagtttctcatgttctgctctcgaggttctgacagctgtttttggacttaattaaccattgcaagtggaaaccaagaaataattgtagcataactctctctattgtcatgttgcttcttctggcaaatatatctagaagttagactttaaaccttgatctcccacaccaaaagagaaaataatatttatatggaagtaattttattttagtgttgggaatttattgtggagagcaggtgtttaaaaattttggaattctttaaccaaattcn

SEQ ID NO: 1390 - DNA, 1833 bp, Homo sapiens
ttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcact

SEQ ID NO: 1391 - DNA, 5434 bp, Homo sapiens
cgtccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgcgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggctcaaagatttggaaagagacagcttaacagaaaaggaatgtgtgaaggagaaattgaatctcttgcacgaatttctgcaaacagaaataaagaatcagttatgtgacttggaaaccaaattacgtaaagaagaattatccgaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcctgaaccttcacctagccccaggattacaaggaaaagcaccaggcaaaccaccatcacatctcattttgcaaagggccctgccaaacggaaacctcaggaagagtctgaaagagccaaatcggatgagtccatcaaggaagaagacaaagaccaggatgagaagagacgtagagttacatccagagaacgagttgctagaccgcttcctgcagaagaacctgaaagagcaaaatcaggaacgcgcactgaaaaggaagaagaaagagatgaaaaagaagaaaagagactccgaagtcaaaccaaagaaccaacacccaaacagaaactgaaggaggagccggacagagaagccagggcaggcgtgcaggctgacgaggacgaagatggagacgagaaagatgagaagaagcacagaagtcaacccaaagatctagctgccaaacggaggcccgaagaaaaagaacctgaaaaagtaaatccacagatttctgatgaaaaagacgaggatgaaaaggaggagaagagacgcaaaacgacccccaaagaaccaacggagaaaaaaatggctcgcgccaaaacagtcatgaactccaagacccaccctcccaagtgcattcagtgcgggcagtacctggacgaccctgacctcaaatatgggcagcacccaccagacgcggtggatgagccacagatgctgacaaatgagaagctgtccatctttgatgccaacgagtctggctttgagagttatgaggcgcttccccagcacaaactgacctgcttcagtgtgtactgtaagcacggtcacctgtgtcccatcgacaccggcctcatcgagaagaatatcgaactcttcttttctggttcagcaaaaccaatctatgatgatgacccgtctcttgaaggtggtgttaatggcaaaaatcttggccccataaatgaatggtggatcactggctttgatggaggtgaaaaggccctcatcggcttcagcacctcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgagaccacggttcctccttctggcctcaacttgaaccgcttcacagaggactccctcctgcgacacgcgcagtttgtggtggagcaggtggagagttatgacgaggccggggacagtgatgagcagcccatcttcctgacgccctgcatgcgggacctgatcaagctggctggggtcacgctgggacagaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtgtgtcagcagcctgagtgtgggaaatgtaaagcctgcaaggacatggttaaatttggtggcagtggacggagcaagcaggcttgccaagagcggaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaagactgatgggaagaagagttactataagaaggtgtgcattgatgcggaaaccctggaagtgggggactgtgtctctgttattccagatgattcctcaaaaccgctgtatctagcaagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggagggaggcatggatcccgagtccctgctggagggggacgacgggaagacctacttctaccagctgtggtatgatcaagactacgcgagattcgagtcccctccaaaaacccagccaacagaggacaacaagttcaaattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaacatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggcctataatgcaaagagcaaaagctttgaagatcctcccaaccatgcccgtagccctggaaacaaagggaagggcaagggaaaagggaagggcaagcccaagtcccaagcctgtgagccgagcgagccagagatagagatcaagctgcccaagctgcggaccctggatgtgttttctggctgcggggggttgtcggagggattccaccaagcaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcagggccgcgtgctccacccagagcagcaccgtgtggtgagcgtgcgggagtgtgcccgctcccagggcttccctgacacctaccggctcttcggcaacatcctggacaagcaccggcaggtgggcaatgccgtgccaccgcccctggccaaagccattggcttggagatcaagctttgtatgttggccaaagcccgagagagtgcctcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaaaaaaaaaaaaaaaaaaaaaaaaaa

SEQ ID NO: 1392 - DNA, 905 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggacgcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacctgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccacggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaag

SEQ ID NO: 1393 - DNA, 2582 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatgtactgggggagtggggtgtgcctgggcccagaaagcaccttggagggaggggtctgggctgggtatcaccttgcgggggtgtcatggggccaggaagctcagtgggagggaaatccctggtgggcactggagggctaggaaagttgtggggggcccttcagccccctaccacaaagttacactgaggctccccccaccgatgctgcatacagatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcaaaaaaaaaaaaaaaaaaaa

SEQ ID NO: 1394 - DNA, 1254 bp, Homo sapiens
ccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggaaaaaaaaaaaaaaaaaaaaaaaaaaaaaaaaaa

SEQ ID NO: 1395 - DNA, 571 bp, Homo sapiens
tgcgaccgcccggtacgctctccaacgccagcgccgcctctcgctcgccgagctccagccgaagagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggacttttaaaacagatctgcgcttccagagcgagctatcggtgctttgcaggaggcaagtgaggcctatctggttggcctttttgaagacaccaacctgtgtgctatccatgccaaacgtgtaacaattatggcaaaagacatccagctagcacgccgcatacgtggagaacccggcttaaaaatccactatgattgggaaaatttacttttcccaaaacaaaaaaaatttcctcttctcctgt

SEQ ID NO: 1396 - DNA, 5621 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtataaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgtgcctggccaagtttcagttctatatgaagtatttgatgttttgtttgaaacaatacagcattaaagaaccaatgttattcactaatatcattcatctttcagtttggatgatttggtttgctgcatctaggttggtgtttgatcatctgaaaaaacatttcagtgggaagaaatgcataaaatgcctataagaagtagaaagtcattgaactgacagtgtttgatgcaactaaaagaggattgtaagacatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaacattgta

SEQ ID NO: 1397 - DNA, 1812 bp, Homo sapiens
gtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaggggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtagagtggaacccccagctattagaggtcccaccccaaactcagtttgattacacagtcaccaatctagctggtggtccgaaaccatattctccttacgactctcaataccatgagaccaccctgaaggggggcatgtttgctgggcagctgaccaaggtgggcatgcagcaaatgtttgccttgggagagagactgaggaagaactatgtggaagacattccctttctttcaccaaccttcaacccacaggaggtctttattcgttccactaacatttttcggaatctggagtccacccgttgtttgctggctgggcttttccagtgtcagaaagaaggacccatcatcatccacactgatgaagcagattcagaagtcttgtatcccaactaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgcccaaggaagacagggaaagtcttcagatggcagtaggcccattcctccacatcctagagagcaacctgctgaaagccatggactctgccactgcccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggagcaggtgccgagaggttgccctgatgggctctgcccgctggacatgttcttgaatgccatgtcagtttataccttaagcccagaaaaataccatgcactctgctctcaaactcaggtgatggaagttggaaatgaagagtaactgatttataaaagcaggatgtgttgattttaaaataaagtgcctttatacaatgccaaaaaaaaaaaaaaaaaaaaaaaa

SEQ ID NO: 1398 - DNA, 971 bp, Homo sapiens
  misc_feature 756: n = A,T,C or G
gaattcatcaacacagacaatgggtccacgtcttgcagctacagctgctgcagctactcctgctgtccgcaccgttccacagtataaatatgctgcgggagtttgcaatcctcagcaacatcttaatgcacagccacaagttacagtgcaacagcctgctattcatgtacaaggtcaggaacctttgactgtttccatgttggcatctgcccctcaagagcaaaagcaaatgttgggtgaatggctgtttcctcttattcaagccatgcaccctactcttgccggtaaaatcactggcgtgttgttggagattgataattcagaacttcttcatatgctcaagtctccagagtcactccattctaaggttgatgaagctgtagctgtactacaagcccaccaagctaaagagactgcccagaaagcagttaacagtgccaccggtgttccaactgtttaaaattgatcagggaccacgaaaagaaacttgtgcttcaccaaagaaaaatatctaaacatcgaaaaacttaaatatggaaaaaaatatcaaaatataaaagaaggaaactgaaccgtatgtaccgagcaaatgccaggtctagcaaacataatgctagtcctagattaattgatttaaaaacaaaaaacacaaaaaaaatagtaaaatatagaaacaaattagtgttttatagaccctgggaaaaagaattttcagcaaagtacaaaaatataaaacattcctttctttaattttgnaattctttactgtggaatagctcaaaatgtcacttctgttttaagtaacagaattaataactgagcaaggaaacgtaatttggattataaaattcttgctttaataaaaattcctctttaacagtgaaaacaaaaacaaaaattggggaattgttaaatgggtcatctcagccccttattacgtgtgctcttggccccaattatgacaaatttgg

SEQ ID NO: 1399 - DNA, 6050 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctgctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctcaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgccccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagctggagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgcttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcg

SEQ ID NO: 1400 - DNA, 684 bp, Homo sapiens
  misc_feature 365, 469, 537: n = A,T,C or G
tttttttttttgctatacatctttttgatcaagaaatgcaatgctcagtctaggaacagcagcagaaatagcgagagacacgggacttttatacaaaaaaatttgttgcttacaaaacatatgcaaaaaaagcttaaaaaaaccagagaccaaaggcagcagccttgctaattttcatctacattaagaaaaaaaaaatcttgtaactaaggtttttattttccttaaaaaaaatatttcgcttaggcacaatttgctgggggctttagaagaataagccaggtttccacagcatcccccttgagagatacgctcgatttctccgcttttaatagataaggcatttttttcttctttgacaaagngaatgttttgttgcttgctttcaggttttgtttactggaaaaaaaaaaagggcaccgggcttgattccgaaatcatggacatgggttgtttcttggggaaatanttttctatcattttatttttctatctatttttttaatttcaactcttatactttgtcttcgtcgtctngcgtgggttttatctttcattattatatcttcattttctttttattttttattttcttattcttatgttatgttcttaatttttacatctctatatttaccatttttctttcgtacttctttttttcttttttatttttaccatttt

SEQ ID NO: 1401 - DNA, 2105 bp, Homo sapiens
cggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagctaaaaaaaaaaaaaaaaaaaaaaaaaaaaaaaaaaaaaaa

SEQ ID NO: 1402 - DNA, 1280 bp, Homo sapiens
tgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattatgtatgtgactatttatataacattagataattaaatagtgagacataaatagagtgctttttcatggaaaagccttcttatatctgaagattgaaaaataaatttactgaaatacaaaaaaaaaaaaaaa

SEQ ID NO: 1403 - DNA, 975 bp, Homo sapiens
acataccaaagacgggtggaaaagaagtattatttttgtagttttctttcataatggaagccttatgctattacagactgcagttttccagtcttttgattaagccttgccagtcgtgtgccgctgcagcaccaaagaaactgttttgcagcctgtcacctcctctggcaggcagccatcctggtctcggagagtggggtcagcaccagactggagcagcagctctacaatatccagaaactcacaggcagaggcataatgtagagctgtttggccttcattgtcctgacagttaatgtcagctctatgttgcagcaacactgtgactagttccttatgtcctcgatcacaggcccagtgaagtagagccctaccctcttcatctttcacattcacatccacatttttcgatttgatggctttggttatatggtcaatgttgttttccctgcagtaatcaaatatatttttgtcttcttccctgatggtttcttcatgatatagagaactaataactggcccaccaaaacctgtatttgcttcttttcctttcttctctggtatctgaggattccaacctggatctagttttttaactactgcgatatattcctgcattgcttggctggggcttgaatcaccaagtgctttccaagcttcccatttttgctttccttcaaaatcaaagaagcttggtttaggagtattacaatttccaactttgacctgtttgtacctggcatacaggtacaagagctgctccctgctggccacctgaatcaggccttgcaggtgcgcggcaschttctcaaacagctcggccaggcaactggtctcctcgatctcagggctatgggggaactccacctccccggagtcgtcccctgagctcagctctccaccgctgtcgccggtgatggccccgcgggcagggaatgatgaagccatgtctccttgctcgctccgtccctctgt

SEQ ID NO: 1404 - DNA, 5036 bp, Homo sapiens
gtttagtgttaacctcagctacactgaaggaatagaccttagtcctcacaagtataagttctagcttggaagcctgggttctgcagtagctgtggaacttaagcctctgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcaggtgtgttatagcacagctatggatacccctcctcaatctgtgaatgctgtgaaggggagggagaagacattctgaaatcagcattgggaagactaggcaatttcagcactattttaagaatctgagtgattcttttccctgaacttctgctttgaggaagagataatatggcccatctttctatggtcttctctgttggttgcataaaatagcattggatttgtccagatctgtttgccggtcttggagtccccagtaacagccttcctgcctggaatgtaggccaggacaaatgtaaaccaatggacaaatgtttctcaaaaattatagaatggctccaagtgcctgagaaatgaagaataaatctgacaaccagaagcagctgtcttgtgaatagagggttaagtgcctggcatttggtgcttgggaggtggccagaatgcagataaggtgaaagttgccctgttctaaatccactcccatgtgacttggttgtaactgagtttagttaaaactgaagtctttcagagtcttcctacagatgtacaattaacagcttctctcatttttctgactcggtgatcccaagaaggcctatactgggtcagttcataccatagtgcacacctcagttgtatagaatccaaggactattctcccatcagcatcggtattcagcatctatgtctttagatccctgatggcgtattattgactcttttttctagagaccaatttgaggcacacctgtaaacggataatggacatggtgagcaaccagcacccctggtttggcatggagcaggagtataccctcatggggacagatgggcacccctttggttggccttccaacggcttcccagggccccagggtaagtctccttgggttagaggtgaaattcccagaagtgtctaactgtgcaggaatgccccttcccagggatgggaatgactttcagaatcaagaagcaaaataatacagtaaaggcgaaacagccctcacatcaccaaagtccaaaaatggatatgaatatataaagtaaggttttagggggaacgtttggccccactgaagctgtggtgaagaggaactcccctattgcccctcccctgccccgcacctgcagatgaaggcaaggatagtgattcaagagggcaaggcttaagggccttctgatctctgactttgggattctctggatttcttgactcttagtgttttgtcctgatgcttctgtaggtccatattactgtggtgtgggagcagacagagcctatggcagggacatcgtggaggcccattaccgggcctgcttgtatgctggagtcaagattgcggggactaatgccgaggtcatgcctgcccaggtaagtatagctccaatccatcaatgaagaagggtaggtaggtgtacataggacttttgctagtaagggctgctgatacaccactcactaacccaaaacctaagaacgggttggagtacaggtgagaagagaacaggtttaggagattctgagttggagtgagcagttagctttgttttaatggccaagcttctcgtt[450 bp omitted]ataatttatataatatatattagtcatatatcattatataaatatatatcgatatatatatttgtgacatatgtcatggtgacagggaaaagttgacaaattcatgcatttgaaaatcttttagaactaaattagtaacaatacaggcatgtggataagcttaatgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagaaaaaaaaaaaaaaaaaaaaaaaaaaaaaaaaaaaaaaaaaa

SEQ ID NO: 1405 - DNA, 3402 bp, Homo sapiens
acgggcggccggatttgcccggaggccgcacccgcctccggcggggctctcagtgaaaaatgtactctgacctgaatcctgaattttccttgatggtcaaaagattaagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacagatgttgttattcatgaggaccaatggattggcgagacagtactacaatcaacatttagcagtcagttattaaatcttgggagttattcatctattcagcctgaagaatattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggagtggttctgattaaagcccagatttcagagctggcatttcctattacagcatctcagaagatagcgctaaatgctcacagttctctgaagagtattttttcttctcttcccaacatcgtatatactggctgtgcaaaatgtggattggaactagaaacagatgagaacaggatctacaaacaatgttttagctgcttgccacttactatgaagaaaatatattataggccagcgttaatgactgccattgatggaagacatgatgtttgtatccgtgtagaatcaaagctgatagagaagattcttctcaacatttctgcagactgcctcaacagagtgatagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttataaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtggttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 1406 - DNA, 473 bp, Homo sapiens
tatattgttttttaaaattatgttttatttaatgagtgcttcttcatttaaaaataatataatctggtcacaaaggctacattctcatctctgaccatgaggtggtcatagttctaggcgtcaaatgctgttctatgaccaattgatcttgagctcttcctagagctgattttaaaaatcattctttaagaatttgcctctctgatatgctcactctctgtatttattatttatatcagaaataaactcatgtatatattaaactaacaaaaatgtgaaattattttagcgatttatatggaaatgtttctaaggagcagggtgagattgtacctctacttatgacatttataactgcagacatctgtttagcttatatgtatgcattccaggaattcaagcaaagggcaaaagattgtgatgctttccatgtcattcaggattgcagtggtttgccatacagataaagaaaa

SEQ ID NO: 1407 - DNA, 5982 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctccgtctaggggatgtagaggtgaatgcagggcaaaacgctacatttcagtgcattgccacagggagagatgctgtgcataacaagttatggctccagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatgtgcctggtcccgtaccagtaaaatctcttcaaggaacatcctttgaaaataagatcttcttgaactggaaagaacctttggatccaaatggaatcatcactcaatatgagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcagctccaactttacctgactatgaaggagttgatgcctctctcaatgaaactgccaccacaataactgtattgttgagaccagcacaagccaaaggtgctcctatcagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgagagcttttttgaaggacagtcagcatcttgggatgtagctaaaaaagatcaaaatagagcaaaaaaccgatatggaaacattatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagtttatggtgacttcaaagtaacgtgtgtagaaatggaaccacttgctgaatatgtagttaggacattcaccctggaaaggagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcagtgctggtgctggacgaactggctgctacattgtgattgacatcatgctagacatggctgaaagagagggtgttgttgatatttacaattgtgtcaaagccttaagatctcggcgtattaatatggtccagacagaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacagctacaggcaaccagctgctttcatcgtcacacaataccctctgccaaacactgtaaaagacttctggagattagtgtatgattatggctgtacctccattgtgatgttaaacgaagtcgacttgtcccagggctgccctcagtactggccagaggaagggatgctacgatatggccccatccaagtggaatgtatgtcttgttcaatggactgtgatgtgatcaaccggatttttaggatatgcaatctaacaagaccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatctttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattat

SEQ ID NO: 1408 - DNA, 932 bp, Homo sapiens
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtttggctgcagcacactctgagaaagaaacttatcctctcctacacataa

SEQ ID NO: 1409 - DNA, 2040 bp, Homo sapiens
agcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttcctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagatttcttgggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagaatcatgcccttatctagcagggaagccaaagatgttttttattcagaactatgtggtgtcagagggcccagctggagacagcagcctctggagggtggatgggccagcgatgaagaatgtggaattcagggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattaaaaaaaaaaaaaaaaaa

SEQ ID NO: 1410 - DNA, 2243 bp, Homo sapiens
ggacgtcgaggcattacaatcgcgaaaccaagccatagcatgaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttcctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatttggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggagaacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccgtccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatgcaaaaattagctgggtgtgggtgtgggtacctgtgttcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaa

SEQ ID NO: 1411 - DNA, 1818 bp, Homo sapiens
tcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttg

SEQ ID NO: 1412 - DNA, 549 bp, Homo sapiens
  misc_feature 409, 438, 457, 459, 462, 464, 481, 536, 540: n = A,T,C or G
aaactgagacagggtctcactctgtcactcaggctgcagtacagtggcatgatctcagctcactgcagcctctgcctcccgggctcaagtgatcctcccacttcagcctgccaagtagctgggacttcggggcatgccaccacgcttggctaattttttgtatttttggtggagatggagtttcaccatgttgcccaggctggtctcgaactcccgagctcaagtgatccgcccaccttggcctctcaagtgctgggattataggtgtgagctaccgcacccagccaagagtcaatctgtgatccctaagattcttattgcctagtaaagatgaaagatgaaaaagagataacaatgaaaacatgagggcatggcagagtaaaataggaagaaaagtccagaatatggnattacagaggcagggattagaaatatttncctgataagtgggtttcancngangnagtattaacaagctaangggcttttgaaaaatctgggcatttttggctgtaccaagatttgcaggttcaaangganttttggggg

SEQ ID NO: 1413 - DNA, 1899 bp, Homo sapiens
taaatttagcatagtaactacagtattagaacttcaaatcacatagattttaatggtatcaatgacaaacagctcttaactaccaaaaacttttccagattaaattcttctagcaggaaatttgagagtcatttgaagaatagtttaatatttagcttagggttttaaaccgccagtcttagcctatgggttcctcagttaatcattagcaacagtaattgtctctgtgtctggtacttggtgtcttaaaatgcagataatttttcttctcaaccctctagaagtgaagctggacaaggtttcatgctgttgctgcttagaaaagagctttgaactacaggaacgcaatgtgggactaaagagcaagatccagaagtgggatgagtcatgcaactcagaggacagtagtgaaggggcagtgaggaatcgacagagggtctgggggcaatacaaagcctaaaatagctaaaataattattagctaaggggctgtactttggacttacagcaaggctagcaacattaccaagggctttctccaatacaaagtattttattttttataaagggtcaatgtagtttctatatatggcagtcattgagtaaactctcttctcagctttaaaacattcttccttgccagccacaattacaggccattttataatcacttcctcctccagcctcaaaactgtccctgttccctgcttcctttccccctagattgaccaactacatatggtagatcatcaaacccaagatttgtcagggggcgggggcaggggaggtggacggtgaatgaggaaagattattattaagctactgctcatgcctcaatgaagcactaaagaatgacataaccacatgacaaacatacttaaattcaaattctggctttgccagtgtcacttcagaatataattcttctgagtctgtttcctaatgtacaaaaatggggacagtgatttcaatctagtagaatttttgcaagggtagatttagtgaggtgatgtgtatgggatagcattcaatagtgcctggtacatagtaaacacccaaatatttttattttgtttttaacttgtttccattggtttagtacttgcttacctttaggatgtatatgtgtgtgtgtgtgtatgtgtacatgttatggagaaatggtcataagatctgaacaacaaaagtatgtttactacttagcaaacatgtctgttggacaggttctgctaacataatgagagtgcatttgtacattcaggtagctaagacttaacaaatctaaaaattccttacttcaaaagttcagctatttaaagtgtttggttcacaattaaaggagattgtgttttaaacaatacataccgtactttttaaaggttgtattagcacatgcaaacagttcaccttaaaaaaacagaatgagtcataaggagtcagacatgccattaatcagctcttaattatcttccataaaagagggaaggaaaaaaatagagataacacgaatctgtgtataatccaaaaggttctctgtgacttggaatgaagccagaaaaagaatctcattttgtttcacacactggcacctggtatggagatcaacagttgctcaaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaagtaaaaaaaaaaaaaaaaaa

SEQ ID NO: 1414 - DNA, 7136 bp, Homo sapiens
gcttatattttttccagctcccaaattccctttattccactttagtcccttcattttcagagatgaggaaacagattgctttgttcaaagacagctagaactagaacacaggctaatacttgctagccatgtgatatactaatgtcagccaaatacgggcatttacactttcagatgtttgccatatctgtgcacttactaattctgtttaatacaatttaaattgactcctttaaataagcttattttaaaggaaattttttgctactataaatagaaaaccattatatcctttaaatagtaactctaaataggaattcaaaacaaagcaacgttattaaaatttaatttaaaattaatttaaatttaattgttattaaatttttaattattgctgttcttcgtcagaaatgtgtcaaagcattgttttcatgtttgatgtcagttccttaattgtctaaacagaaaaagcacagctaatgcctctagttaagcttctgtataacttttttaaatgaaatgcttcttagaggggaaatgagagggcatgaatacatgtttatatactaaagtatgatttcatgtatatcagaagatcttattatatggaaccaaaattattctttggttgatttaattgttcttgaaacttcagtttttaccttgaaggttttagttagcttagcataagtttatttttctaaataaggaatctgattgcctcacaactcagatgtatcacagttatggtgaaatagcaatatattggtttctgtaaccttttaaataccgtaatgaattaaaatctcttcagcaaaagcaaatatatctagggtgacgagaggtgtttttagtgtatttgaatgatggaaatgtttttcttaaaatatttctgaagcattttttaaaataattttttgaatttattgatgatagtagttgtgtgttagtgtgaatgactggtctaaatgtgtatgtcacttccaagggattagtaggggtcagaatgatttgttttattcattgacttttcctttgacgtgttcttattcattgggctacatacattccctgttgccttctcaccaaaagtgccactacacaggctgtatttcattgtactgtagaaaaagacaagtagacctttttcattcatgagattcctatgaaatctgttggtggaggtataaaatgaggagacttttatgggctagctagtaggagttttgctgtgaaacctttgtaacaggtctatcaggaactagggagagaaataaatgcaggaaatacttgatcccattaaactgaggatgaaaaagacatgataatattttggggattatttattgtgtgattttccggctgatcagaagtgttaattttttgttatacttgtgtcaaatacatatatatatatatattttgaaatggagtcttgctctgtcacccaggctggagtgcagtggtgcgatctgggttcactgcaacctctgcctccaggttcaagtgatcctcctgcctcagcctcccgagtagctaggactacaggcacgtgccaccacgccctgctaatttttgtattcttagtggagatggggtttcaccatgttggccaggctggtcttgaactcctgacctcaagtgatcttcccaccttggcctttctgaactatttcctttacacacatttagaactacatctaactgtattatagttttcactttcaccatcagacaaaattcagaagattcaagagaaggaaagtcgattgtatttactcatatttttgctaccgtgtttttacatctcatattttaaggctctcttaattatttattttctgtttagttaatttcctctagccattctttatttatagtgggtctgctggtaacaaattctctcaatttttcctcgtctgagaatgtcttgacttcccttccatttttgtcagcacctgaaaaatactatgccactatcttctgggttctgtggtttctgatgagaactccactgtcagtctaattgtcgttataaatgcagtgttctctctctctctctgcttccaggatattttttcttttttttttttttttttttcttgagacggagtctcactctgtcgcccaggctggagtgcagtggcgcaattttggctcactgcaagctctgcctcccgggttcaagcgattactcccactttagcctcccaagtagctaggactacaaggcacaccaccatgcctggctaatttttgtatttttagtagagacggggtttcaccatgttgcccaggctggtctcgaactcctgacatcaagtgatcttcctgcctccgcttcccaaagtgctggaattacaggcgtgagccactgctcccagcctctttattttttcagctttactctttcttctgtctttttgacatgtgtgtccagtgacacacgtgttagattttgctatagtctcacgcacgggtctataaggctctgttttttgtttcattttgtttttcctattttctctctattcagatcgagtaatttccactgttcagttttatcatagctgcttttaaatctttgtcaggtaattctgtcatctaagttttggcacctattgattatcttttgcattgtttttgtttttgtttctgtttttgttttgagatggagtcttgctctgttgcccaggttggagtgcagtggcactgatctcggctcactgcaacctcctcctcccgggttcaagtggttctcctgcctcaacctccttagtagctgggattacaggcatgtgccaccacgcccggctaattttgtatttttagtagagaccaggtttatccatgttggtcaggctggtctcaaactcccaacctcaagtgatccgcctgcctcgacctcccaaagtgctgggattacaggcgtgaaccactgcacccagcctatcttttgcattgttttaaatcttgttcttgctaggatgaatgattttctgttaaaactagatattttcatattatgttcctaggctctggatattatctaaaccttctgtttccactggcttttattgacactgctttggcaaggtcatagggggtgcctcattactgccaggtggacatagaagtcaagggtccctactcagcctctactgatgcctcaggaagaggatccttcttgttattgctgggtgggggtggaagtctagctgacacctactgaggtaggtgctggggcatgcccggccatcagggtgaaagtcctggctccctagttggcctacttttacattgccctaatagggcattggagctcctcactatggtttatgagctggaagtcaaggctcctcacttagctttcgttggtgtgggtggtggtggggcaaaactgttttctgggtttggctggagtggagcagttactgtcaaaagttttctgtcttgccaggctgtccctttcttgtttctttggctagagagagcaagcttttgttgtggctctttttgtctgtgccagttggcatttccaggttgctgccttctttagctccaagtctgggatatattaggcaaaaagaaaacccagagaatttacaccaccgtgtcattccatgggtcctgaggtcccttacttagtctgccttctctccacttttcacagtcttctcatgttttgtatataatgtccagggtctttagttatacttagcagaaataaaagggaaaagtatgtctgctctatgcttctgtaagtggaagtcttcaaatttgcatttttgattcctttaaacagttttgtaaaatatataatcattattgggcaaaatgtcccataaaatgtatataccttgtgatggtttgcataatattgtgttcaagaggactgctgaaaaataacatctttatttaaactgaaacgaattgttcacattattaatgaaaacttttcccctctaggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttaggctataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttgtctcgggcccagactgtggtggttgaatatactcatgacagcaacacagatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaata

SEQ ID NO: 1415 - DNA, 869 bp, Homo sapiens
ggccaccggaattaacccttcagggctgggggccgcgctatgccccgccccctccccagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctctcttggtttca
